United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 24

SEQ ID NO: 26809 - DNA, 2369 bp, Homo sapiens
tggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaat

SEQ ID NO: 26810 - DNA, 5347 bp, Homo sapiens
gcttgtccggtggctgctgcgctgccgcaacgaatagggtttctggctgcgtaggagggacgggggcgcggagctctgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttcctatcatggaatcttcatccatgtgtcattcatgctgctctctaggcacactcattgtccttaatgaaggtctgtgtgattgtaaggactgcatagacacatgagcttctgcacagctcagcggtaagcaggggtcccctgtcgtttcccttcttaataacagatgtgtattaagctttacaattcttagagatatcttaagctttggccaactccaggaaatcttcaagtgccattgtctttccaaaaactgcatgttttatggcctttgctcacctttttgtcgtgactggtaatcaaagcaagattatactattctgagtgattaaggaacccatgcagggtttaaaatccattttcttgctattgtccaatgtttacagagtactcaaaaggttttcctaaagtaatctaatttccatctccaatttaattcaattttcagcattgtagcatttcctttggtgtttgttttttttttttagacggagtttcaaaatttggattcatattcatatgtgggaaatcccagatttttttttttttttttttttttttttttttttggagacagagtcttgctctgtcacgcaggctggtgtgcaatggcgcgatctcagctcactgcaacctccgcctcccgagttcaagcgattcttctgcctcagcctcccgagtagctgggatcataggcatgtgccactacacccagctacccagctaatttttttttttttttgtacttttagtagagatgggatttcaccatgttggccaggctggtcttgaactcctgtcctcaggtgatccacctgcttcggcctcccagagtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaaggagttaagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaatttttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagcaggtactggtcctttttcctctcatttttgtggaaaggatatgcaaacactgaatttctcagggagtactaaggctgtgcagaggctgagaatctgaaaaataaaatactaaaaataaaaa

SEQ ID NO: 26811 - DNA, 5347 bp, Homo sapiens; identical to SEQ ID NO: 26810

SEQ ID NO: 26812 - DNA, 5119 bp, Homo sapiens
gagggccgccgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaa

SEQ ID NO: 26813 - DNA, 1490 bp, Homo sapiens
gcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaacatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagttctgcagagctagtttttgtaagccatgtaatagatccttgccatttctacattcggaagtattcacaaataaaagacgccaaagtactggagaagaaggtgaa

SEQ ID NO: 26814 - DNA, 4979 bp, Homo sapiens
ggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatgaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttcc

SEQ ID NO: 26815 - DNA, 3726 bp, Homo sapiens
gttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggat

SEQ ID NO: 26816 - DNA, 569 bp, Homo sapiens
ccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccac

SEQ ID NO: 26817 - DNA, 1249 bp, Homo sapiens
aagaaacaagctgggcagctctgggagagaggagtgtcagacagctgttgtcaacaggcacctggccagagtgaaaaggaggggcagattccatccaagtcccagcggcgccagctgacactctctgccaatgcccaggtgctgagcgacagtgtcccaccggtccctgtgcccagaatggcctgcaccaagaccctgcaacagtcccagcccatctccgcaggagccaccacaaccaccaccgctgtggcccctgctgggggtcattctggctccacagaatgtgacctggagtgtctggtgtgccgggagccctacagctgtccccggttgcccaagctgctggcctgccagcatgccttctgcgccatctgcctgaagctcctgctgtgcgtgcaggacaacacctggtccatcacctgcccgctgtgccgcaaggtcaccgccgtccccgggggcctcatctgcagcctgcgcgaccatgaggcggtggtggggcagctggcccagccatgcacagaggtatcgctctgtcctcaggggctggtggatcctgctgacttggcagcaggacaccccagcttggtgggagaggatggacaggatgaagtaagtgcaaaccacgtggcagcccggcgcctggccgcgcacctactcctgctggccttgctcattatcctcatcgggcccttcatctacccgggtgtcttacgatgggtgctcaccttcatcatcgccctggccctgctgatgtccaccctcttctgctgtctccccagcacccggggcagctgctggccctcctccaggactctcttctgcagagagcagaaacacagccacatctcttccattgcctgagtgccctctgatgaggctatccctgcagccctttctgcccttgggcccccggacttccacaatgaacagggtaaggggttacggactaagactggctcctttgggaaatcacatgccagcgggacttgcaagccacaaccgagatggccagcctgggtcaagaattacacgcttggatgacaggcttgcacttgcccttgggatagcatagctaaaactgttggtggctaggggagcagacacaaactacttgaacatgacaagatgggggaagctcctgttcctcttattccaatgttcttggtttttctttatataacttgatgaaagtattgcagtattgatgccattgtagaatagaactggaattccattctttttgcaattt

SEQ ID NO: 26818 - DNA, 1677 bp, Homo sapiens
cccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtat

SEQ ID NO: 26819 - DNA, 3606 bp, Homo sapiens
cggcgcaccctccctcgcgccgcgggcctccccgcgccgtgcacgtcctcgtcccgcgcctccgcccctcgctcgctcgctccttcccgccctccccgcagcgccggccgagccggcttcccctcagtctctcatgaatattgagcggcccctgttgtatttcccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtgtgtgtgtggatgtgtgttttggggtacggggagaggcgatgctattggccatcactaccaaccagggtttcaaaaagtattacctaagtaatttcttttatcactatctcaactgaggaagaaaaggctcaccacaagtggtgtgaaggctttgggtacttagttctaaatttttttatggtaacatatacatagccacatttacagttttaaccattttaaggcatgtaattcagtggggttaggtacattcacaatgttgtgtaatgatcaccgctgtctacttgtaaaactttttcatcaccccaaacagaaactctgtgtgcaattaaagtaatgcatttctcttcttcttaacccct

SEQ ID NO: 26820 - DNA, 942 bp, Homo sapiens
ggatgtgtgtctgcatcgtgggggtggggtagggggcactttgtgcagatatcgctccttccttctggggggtcggagtcggggttccagtgtagaggagctcctcgacctcggggttcctcggggagaccccttcagcttcacacattcctggagtgccgcctcctgctctggagtatctgttgctgctttctaaaacccaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagata

SEQ ID NO: 26821 - DNA, 1019 bp, Homo sapiens
ggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccagggaaacaccatccaggacgcacctcaccccctcaccctgctccatcccagcaggaccctcattcacaccaagtccccttggggccagaagttgcttgagttcataaaacatgtctgttatcacagacatcagagccacaggccgtgcgctccagggtggttttgccaagtgctgcagaggccaggtgctgtctcaggagagaagacccagcagacccggccagcccctccagccacctgtctgctctgcctctcgtgcctctcaggcttccggcatgggccgtggaggtcacaggctctgcccagtgacctcgtggccccactgtttgtcagttacactgtggaggtgagcatcacaaacgcagggtggagttttcccgcagctgtgtgacgtgaggtggtattgtaacatttatgctctaatatcaacgtaacataaatattggcatttgttacaatatgttaacacatcatggatttattgttatttttaaatgaattaataaatacttttagatttgt

SEQ ID NO: 26822 - DNA, 2332 bp, Homo sapiens
agagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcaggatattaaccttttacccaatttgctttgtaattttatatttgacctttgaattttagagacaatatttttatgtactcatatatattgttattatcccttttattttataggttctcatgcttagggagtttttttttcacatacttaaatcatttttttctaactgggtggtttttaaaactttttcttagagcagttttaggttcacagaaaaattgaaaggaaggtacagatttcccatatacaccatgactccacacacgcacagctcccccatcatcctcatcctccaccagagcagtccatgtgttaaaactgatgatcctacttgaatacatcattatcacccaacgtccatggtttacattagggttcactctaggtgtcgaatgttctatgggtttgaacaaatatctagtgacatgtgtccccatcgtagcagcatatggaatagtgccacaccctaaaaatcctctgtgcgccacctgttcatccttcccccacctcccaccaacccttgacagccactgatctttttacggtccctttttcagactctcctggagttggaattgtacagtatgtggcttctcagattgactcctttcacttagcaatacacacttatggttcccccatctcttctcatggtttgctagctcattttttcagtcactgaataatattccattatctggatgtatcatagttcatccattcacctactgaagggcatcttggttgcttccaagttttggcaattatgaattaagctgctatagatgtccatgtgccagggttttgtgtagacatgttttcagctcctttgggtaaatactaaggagtgtgaatgctggatcagatggtgagagggtgtttagttttgaaagaaattgccaaactaccttccaaagtggcagcagcttttcgcattcccactagcaacgaatgagagttcctgttgctccacgtcctcacatttgatgatgtcagtgttctggattttggccagctgataggtatgtagtggtatcttgctgttttattttgcatttcattgataacatatgactaggagcatcttatgctgatttttcatctgcatatcttctttgctgaagtgtctgttaaggtatttggcccattttttaattggattgttttcttattgttgagttttaagagtcctgtgtatattttggatgacatttcttttttgtgtgtcttttttttggatgacatttccttatcagataaatatgtatcttgaaaat

SEQ ID NO: 26823 - DNA, 1074 bp, Homo sapiens
ggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcagg

SEQ ID NO: 26824 - DNA, 5313 bp, Homo sapiens
cagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccacggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgagacagagtttcactctttttgcccaggctggagtgcaatggtgcgatcctggctcaccgcaaccgctgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattacaggtgtgagccaccgcgcccggccgagcataatgttttgaaagaccgctcaggctggacacggttgctcacgcctgtaatcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcagtgagccatgatcacaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgat

SEQ ID NO: 26825 - DNA, 11651 bp, Homo sapiens
atggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaatgaattttattttacttgtcacacctgtcttaataaactggagttttgctgct

SEQ ID NO: 26826 - DNA, 4796 bp, Homo sapiens
cagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatga

SEQ ID NO: 26827 - DNA, 17730 bp, Homo sapiens
gacagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaatgaattttattttacttgtcacacctgtcttaataaactggagttttgctgctaaagaa

SEQ ID NO: 26828 - DNA, 21055 bp, Homo sapiens
cagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaatgaattttattttacttgtcacacctgtcttaataaactggagttttgctgctaaagaactcttctctctgggggcagagcttctatttatggcacatagacatcagctaggcttttgggaatcgtttgtgttctttgtggaaatgtcctttagaagcacccatgaagtagtgtgttcagactgtgcacacagaaaacaggctctgccttcacatgtgagacggtggacttttcctctggacaaaatgacagcatcctggcgactccacagtggagctgagcgccactccctgtagccgatctgggactgaaacgcttacacctctgcctcagaaggagtcccccatgccctgcctgaaatgacttcactggacacagcggggctgcagctaacggggtacaggtaggagctaactaacttcacccctgagtccacttgcggggtaagagataaacagtaacccttccaggagcccactgacgttggagtgctaaaaatgccccttcagggggaaaactgcattttctcttccaaaaaggaaaggttcttccaggcgagaaacctgtggtctagaaccacagcaagaagaggaggcatgctggcctgcaccggaagactcactttgtctgccctgcgccagcctcacctcaccctgcagttcccgtttccgccatggatgcctcatcaccaaccctgaccttccccctcccaaccctttattcatcctcactcccactcatacccgcctccctggacagttccctgctgcagagttctttctgctttcagccctaccttggtggtgatttacctgaaaatcttcacaactgatcattatctccttctctttgagacctgactgaaaaaattaggtgtgcacacctgtaatcccagctacctgggaggctgaggtatgaggattgcttgagcctgggagtttgaggctgcagtgagctatgattgcaccactgcactccaacctgggtgacagagtgagaccctgtctcaaaaaaaaataaaataaggaccttattgtgtgtgcaaattatttgcctttcatgaatagttatgagactttgtgcatgtgttaaccgagacggccctgagctatttcagttactcctgtatgttcaggcaattccaatttagaaacaaacttccagtgataaatattgggaagaaaatgtcagctcagggccaagtaggtaaagccacccaagtctagccatgcacacaggcactagtgtgctgaaggaaaacacctctgatttgatacataaagtgtgaaggttgcataactggggaggtggctggagaaaacctgagcctcgagctgagtaacaatccaagccatgattagcatttatattgcattctgcattattctcatcctatcacgttcattaagttcaaccattaccattacgaatcccgtttccagctggaaaaacaagcgccaggaaagtgcatttcccccccaccccccccccccaaccagagcaactttggtcagaagtcacacctaatcaccctctctgcaggatatgctggggatagcccttttgaggaggtgggggtgtatgcgaaagcaacctggggccaaagcagggggaagcaggagagactggaggggccctgggtccagcaagtgctccaccaggctgcccctgctcaggtgctccacagcccataaaaaacgccttcagccctgctgtgcttcccctcacacctaaacttactataagggtcctaccttccccagtattccttcatgatcactgctacctgtgccctgaagcgcaacagaacctcaacccagaggacagccacttcctcagaacccacgatctttgccccatcgccacaggtccatgagtgactcctaattaccaaatccaagggctccttcaccctgaccactctggaacccaacaaagctgacacacagcccagcccagacaggcctgaatgtgggtcctggctctcccatttgccagttctacagccatgggcaagtggctcgacctctctaagcttcagtttcctcgtctgtgaaatatctgtcagtgctcttaagggaggagaccaccccacatattgtcttacgcccaatttctgcctccaaagagagaagtaaaaactaaaaggcagaaatgaaatccacaagcagacagcctgcaccacaccctgggcctggtagttaaagatcgacgcctgacctaatcagtgatgctatctatagattacagacattatatagaaaagcaccgtgaaaatccctgtcctgttctgttccgttctaattacgggtgcatgcagcccccagtcacgtaccccctgcttgctcaatcaatcacgaccctctcacgcagaccccttaagagttgtgagcccttaaaagggacaggaattgctcactcggggagctcagttgttggagacatgagtcttgccgaagcgcccggctgaataaagcccttctttaactcgtgtctgaggggttttctctgcagcttgtcctgctacatttcttggttccctgaccaggaatctaggtgattaatggatggttgaggcagcccctcagacggcttaggcctgccctgtggagcatccctgtggaggactccagccagcttgagcgacatggatcctgagagcgctctcaggcaggcaattgccccagtggaatgcctggccagagcagtgtgtagcaggcccccgaggaggatcaacgcagtggctgaacaccgggaaggaactgccacttggagtccagacatctgaaacttggtaagactggtctttggaacttgcccactccatttgaggggaagcgtggcctgatcacccacggcgtgcctgtactggcactctggtttttgtttttgacttgacttggattgcttgatactttggttttggttttgacctgacttggatatcctgatactctgattttggttttgattttggtttggtgtaaactgtaaaagtgtgtgtgtgccctttttacctgttctttgttttgtggtatgcgtgtagggtgagcgtaatgttttgtcttgaagaagcatgggtcaagcacaaagtaagaccaccccactaggaactatgctgaaaaatttcaggaaaggatttaagggagactatggagtactatgacaccaggaaaacttaaaactttgtgtaagatagactggccagcattagaggtaggttggccatcagagtgaagcctggacaggtcccttgtttcaaaggtatggcacaaggtaacctgtaagccagggtacccacaccagttcccgtacacagacacttggttacagctggttttagactccccacccgcccgccccaacagtggttgagagaacagcagcataagtggctggcagaggcaaggaaagaccagcagagagagaaagaggaagagacagacaaagagggagtcagagagagagagagaaagagacagaggcaaaaggaaagtcaaagagaaagagacagaaaatcaagaggaaaaaaa

SEQ ID NO: 26829 - DNA, 3293 bp, Homo sapiens
agtacccggagtgcctctatggttcttcctgtccttagtcgggagggggcgctgtgcgcaggcgcgaggtgacgccgcggcagggccggaaggagtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatccccca

SEQ ID NO: 26830 - DNA, 570 bp, Homo sapiens
agctgcggcttctgaggagtaagcggcgcggtagcgaaggccgccgaacctgcctggctagccggcgacttgagtgacgacatcaccatcctgtggtcacctgatctcagcgtctaggtcaactttgattcctttcttcttgccctgatggccagtgacatacacagatcccatcgactctaactctgcagtcagtgtcttgtattcttctcctccccctaggccatgtttcctgactctggttctatggccatggtgaataacagctccagtctttgacagaggaagaagtttttggagccactcgttcaacaactgtgctaggcattggaaatacaactataagtaagaaaagaggccaggcacagtgacttacgactgtaatctcaccactttgcctctggaacaggacccaaggacattatcattatacagctatctgttcttttgaaacagatggtcaccatgtttagatattagcagtcccatatatgcatgtctgcatttgaaaatggaagagggaaacaacaatgaagaggtaattcacttgaacaactttcactgccatcg

SEQ ID NO: 26831 - DNA, 5639 bp, Homo sapiens
agggggcgctgtgcgcaggcgcgaggtgacgccgcggcagggccggaaggagtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcagcaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 26832 - DNA, 2286 bp, Homo sapiens
aggagtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctccccca

SEQ ID NO: 26833 - DNA, 3341 bp, Homo sapiens
ctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaa

SEQ ID NO: 26834 - DNA, 3242 bp, Homo sapiens
gcccctcgcgaggggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgattcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaa

SEQ ID NO: 26835 - DNA, 3149 bp, Homo sapiens
atgttgaataagagtggtgagagcagatatcctgccttgttcccggtcttagggggttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttg

SEQ ID NO: 26836 - DNA, 3295 bp, Homo sapiens
ggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgaaacttccagcactatgttgaataagagtggtgagagcagatatcctgccttgttcccggtcttagggggttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttg

SEQ ID NO: 26837 - DNA, 2787 bp, Homo sapiens
acacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttccttccaaattaatcccagaccccctaaaatattgacaaccttgacaaccccccaaccgaggagccagactttgttttggactaacttccatagccctatcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacggacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctgac

SEQ ID NO: 26838 - DNA, 3627 bp, Homo sapiens
attggttgggacctggccctccctcttggccgcgccccctggtttcctgacaccgctccaaccttaaccttaagccccgcccgttcctccgaaattgggtcgcagtcccaccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccagg

SEQ ID NO: 26839 - DNA, 1804 bp, Homo sapiens
ctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccaccc

SEQ ID NO: 26840 - DNA, 2851 bp, Homo sapiens
atggacttatgcaccagggctggggagcccagcctaactcaaaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccaccc

SEQ ID NO: 26841 - DNA, 578 bp, Homo sapiens
agttgccactaggagaggcggtgctggctgggtcacagtccaggggctgcccgagggaggggctagggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaaga

SEQ ID NO: 26842 - DNA, 550 bp, Homo sapiens
ttctttccgcccccctcctcccgctggcaggccgcaagcagtaggtagcccctcagccattcccagccagttgccactaggagaggcggtgctggctgggtcacagtccaggggctgcccgagggaggggctaggccccgcccgttcctccgaaattgggtcgcagtcccaccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttg

SEQ ID NO: 26843 - DNA, 1898 bp, Homo sapiens
atgcgaaaagcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagctttt

SEQ ID NO: 26844 - DNA, 2066 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagcttt

SEQ ID NO: 26845 - DNA, 2051 bp, Homo sapiens
atcaccgcccagagggaaggaggtcggcagtgtgaggagctgctatggtgctgagtttcctggtagagccggccgagctgaggcggtcgcggccatgaaggtgggggagtggtactaaggatcaagtatactgttaaaagaaaacaaaaacccaagcatgaggaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagc

SEQ ID NO: 26846 - DNA, 5012 bp, Homo sapiens
gcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatc

SEQ ID NO: 26847 - DNA, 5104 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 26848 - DNA, 4945 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatc

SEQ ID NO: 26849 - DNA, 5254 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 26850 - DNA, 1659 bp, Homo sapiens
gcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttacctataagcatattgccagattttctcccagaaacaggctgtgccaagcagatgcagtttttaacaataatctagcaggatttcagttacagagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttc

SEQ ID NO: 26851 - DNA, 4064 bp, Homo sapiens
aagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 26852 - DNA, 1976 bp, Homo sapiens
agtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttacctataagcatattgccagattttctcccagaaacaggctgtgccaagcagatgcagtttttaacaataatctagcaggatttcagttacagagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttc

SEQ ID NO: 26853 - DNA, 4985 bp, Homo sapiens
cttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 26854 - DNA, 2206 bp, Homo sapiens
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26855 - DNA, 756 bp, Homo sapiens
atgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtga

SEQ ID NO: 26856 - DNA, 1961 bp, Homo sapiens
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 26857 - DNA, 1970 bp, Homo sapiens
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26858 - DNA, 2161 bp, Homo sapiens
ggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgagcccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 26859 - DNA, 1970 bp, Homo sapiens
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26860 - DNA, 2206 bp, Homo sapiens
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggggggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26861 - DNA, 2206 bp, Homo sapiens
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26862 - DNA, 2206 bp, Homo sapiens; identical to SEQ ID NO: 26854

SEQ ID NO: 26863 - DNA, 1970 bp, Homo sapiens
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26864 - DNA, 1970 bp, Homo sapiens; identical to SEQ ID NO: 26863

SEQ ID NO: 26865 - DNA, 1970 bp, Homo sapiens
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26866 - DNA, 2206 bp, Homo sapiens
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26867 - DNA, 2206 bp, Homo sapiens
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 26868 - DNA, 1970 bp, Homo sapiens; identical to SEQ ID NO: 26857

SEQ ID NO: 26869 - DNA, 2206 bp, Homo sapiens; identical to SEQ ID NO: 26867

SEQ ID NO: 26870 - DNA, 1970 bp, Homo sapiens; identical to SEQ ID NO: 26857

SEQ ID NO: 26871 - DNA, 756 bp, Homo sapiens; identical to SEQ ID NO: 26855

SEQ ID NO: 26872 - DNA, 756 bp, Homo sapiens; identical to SEQ ID NO: 26855

SEQ ID NO: 26873 - DNA, 756 bp, Homo sapiens; identical to SEQ ID NO: 26855

SEQ ID NO: 26874 - DNA, 756 bp, Homo sapiens; identical to SEQ ID NO: 26855

SEQ ID NO: 26875 - DNA, 756 bp, Homo sapiens; identical to SEQ ID NO: 26855

SEQ ID NO: 26876 - DNA, 756 bp, Homo sapiens
atgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtga

SEQ ID NO: 26877 - DNA, 756 bp, Homo sapiens
atgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtga

SEQ ID NO: 26878 - DNA, 3088 bp, Homo sapiens
agtgcgctcgattgtgggcgggggcggaaagaggcgcgttttaaagtggtaacagatggttttcttatccaataggattaaaaaatttgtccttacccggccgaccgcggaagtagagtaggcgggcggccaatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacca

SEQ ID NO: 26879 - DNA, 558 bp, Homo sapiens
tagaagtgctggagactcccccaacccctccagcccctgagcggtggtactgtctaggagcgcgccgcggcccctgggcctcgctgtctgtcctaaatcattccggtgaacctctccggctgcgtagctccttgcccccgcgtcgcttggacacgggtggcatcctgggtctggcctgggcctcccgccggcctgctcctgagcccgccgcgtcgcccgccaggtgggaggaaaagaaggcccttgcggcggccccggcggcgccctcgcaggacgagcgcgtgcagcagctgcggcgcaggatctcggagagggcggccgagcgcagcaggcaggcggccttgctgcacgtgtcggcgccgcggaccgcgcgccccaagccccgggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaag

SEQ ID NO: 26880 - DNA, 2098 bp, Homo sapiens
agaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtggaatctcactctgtcacccaggatgcagtgcactggcgtgttctcggtctcactgtaacctctgccatctgggctcaagtgattctcctgcctcagcctccggagtagctgggattacaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagccca

SEQ ID NO: 26881 - DNA, 4123 bp, Homo sapiens
tttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacc

SEQ ID NO: 26882 - DNA, 416 bp, Homo sapiens
gcttctgcttggctgcctagtccacagcctcccgattcaccattcacctggtcccagcaacagaagtctcagctggacacacaacatgctttagagacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttaga

SEQ ID NO: 26883 - DNA, 2799 bp, Homo sapiens
aatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtggtaagtgttggagtccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacc

SEQ ID NO: 26884 - DNA, 2947 bp, Homo sapiens
atggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtggtaagtgatgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 26885 - DNA, 1373 bp, Homo sapiens
tttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctc

SEQ ID NO: 26886 - DNA, 5283 bp, Homo sapiens
gtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaattatcagccggaacgagcaaacagacggagttttaaaagataaatacgcatttttttccgccgtagctcccaggccagcattcctgtgggaagcaagtggaaaccctatagcgctctcgcagttaggaaggaggggtggggctgtccctggatttcttctcggtctctgcagagacaatccagagggagacagtggattcactgcccccaatgcttctaaaacggggagacaaaacaaaaaaaaacaaacttcgggttaccatcggggaacaggaccgacgcccagggccaccagccc

SEQ ID NO: 26887 - DNA, 5160 bp, Homo sapiens
gtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaattatcagccggaacgagcaaacagacggagttttaaaagataaatacgcatttttttccgccgtagctcccaggccagcattcctgtgggaagcaagtggaaaccctatagcgctctcgcagttaggaaggaggggtggggctgtccctggatttcttctcggtctctgcagagacaatccagagggagacagtggattcactgcccccaatgcttctaaaacggggagacaaaacaaaaaaaaacaaacttcgggttaccatcggggaacaggaccgacgcccagggccaccagccc

SEQ ID NO: 26888 - DNA, 1168 bp, Homo sapiens
gaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 26889 - DNA, 1168 bp, Homo sapiens; identical to SEQ ID NO: 26888

SEQ ID NO: 26890 - DNA, 1325 bp, Homo sapiens
gaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacagggccgttttctacttctcctgctttcttccactaccttattgggaacaccagccgtgagttcagaggcagaatctacaatttctggcttcccaggaatctctgaaggaggaaaaatccagtcagaggctgtaattgtgaaggttctcaaactctgtgtgtggaaatgaggccagtggaagtcagaggccctcatgggccaaggctggggttgaaggctttttcttaggtaagagggaggccttggagaagaccctggaattcttacggtagacacggactcggtagttggacttggtctcctttccattcctgttcattgcctggcaccggaaaatcccctcatcctggatcccgacagccggaaggaagagggagccgttgggaaggacacgagccacactgtcccaggggcctcctccctggggagacaggaccttccaagcttctgtccggcctgtgttctagaagcagagaagcagggcctaaacagtgcaaggcctttgggaaaggactgtgaggcagagtgacggggatccaaatcattgctggtctccctggaagttgggaggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtgggg

SEQ ID NO: 26891 - DNA, 1168 bp, Homo sapiens; identical to SEQ ID NO: 26888

SEQ ID NO: 26892 - DNA, 1168 bp, Homo sapiens; identical to SEQ ID NO: 26888

SEQ ID NO: 26893 - DNA, 1168 bp, Homo sapiens; identical to SEQ ID NO: 26888

SEQ ID NO: 26894 - DNA, 1168 bp, Homo sapiens; identical to SEQ ID NO: 26888

SEQ ID NO: 26895 - DNA, 1162 bp, Homo sapiens
tttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccagagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccggcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttcatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 26896 - DNA, 1325 bp, Homo sapiens; identical to SEQ ID NO: 26890

SEQ ID NO: 26897 - DNA, 1325 bp, Homo sapiens
gaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacagggccgttttctacttctcctgctttcttccactaccttattgggaacaccagccgtgagttcagaggcagaatctacaatttctggcttcccaggaatctctgaaggaggaaaaatccagtcagaggctgtaattgtgaaggttctcaaactctgtgtgtggaaatgaggccagtggaagtcagaggccctcatgggccaaggctggggttgaaggctttttcttaggtaagagggaggccttggagaagaccctggaattcttacggtagacacggactcggtagttggacttggtctcctttccattcctgttcattgcctggcaccggaaaatcccctcatcctggatcccgacagccggaaggaagagggagctgttgggaaggacacgagccacactgtcccaggggcctcctccctggggagacaggaccttccaagcttctgtccggcctgtgttctagaagcagagaagcagggcctaaacagtgcaaggcctttgggaaaggactgtgaggcagagtgacggggatccaaatcattgctggtctccctggaagttgggaggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtgggg

SEQ ID NO: 26898 - DNA, 1325 bp, Homo sapiens
gaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccagagagcagagggggattccagccatttggtgataccgggggcttccacttctcatttggtgttggtgcttttccctttggctttttcaccaccgtcttcaatgcccatgagcctttccgccggggtacagggccgttttctacttctcctgctttcttccactaccttattgggaacaccagccgtgagttcagaggcagaatctacaatttctggcttcccaggaatctctgaaggaggaaaaatccagtcagaggctgtaattgtgaaggttctcaaactctgtgtgtggaaatgaggccagtggaagtcagaggccctcatgggccaaggctggggttgaaggctttttcttaggtaagagggaggccttggagaagaccctggaattcttacggtagacacggactcggtagttggacttggtctcctttccattcctgttcattgcctggcaccggaaaatcccctcatcctggatcccgacagccggaaggaagagggagccgttgggaaggacacgagccacactgtcccaggggcctcctccctggggagacaggaccttccaagcttctgtccggcctgtgttctagaagcagagaagcagggcctaaacagtgcaaggcctttgggaaaggactgtgaggcagagtgacggggatccaaatcattgctggtctccctggaagttgggaggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtgggg

SEQ ID NO: 26899 - DNA, 1325 bp, Homo sapiens; identical to SEQ ID NO: 26890

SEQ ID NO: 26900 - DNA, 1325 bp, Homo sapiens; identical to SEQ ID NO: 26897

SEQ ID NO: 26901 - DNA, 1325 bp, Homo sapiens
gaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacagggccgttttctacttctcctgctttcttccactaccttattgggaacaccagccgtgagttcagaggcagaatctacaatttctggcttcccaggaatctctgaaggaggaaaaatccagtcagaggctgtaattgtgaaggttctcaaactctgtatgtggaaatgaggccagtggaagtcagaggccctcatgggccaaggctggggttgaaggctttttcttaggtaagagggaggccttggagaagaccctggaattcttacggtagacacggactcggtagttggacttggtctcctttccattcctgttcattgcctggcaccggaaaatcccctcatcctggatcccgacagccggaaggaagagggagccgttgggaaggacacgagccacactgtcccaggggcctcctccctggggagacaggaccttccaagcttctgtccggcctgtgttctagaagcagagaagcagggcctaaacagtgcaaggcctttgggaaaggactgtgaggcagagtgacggggatccaaatcattgctggtctccctggaagttgggaggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtgggg

SEQ ID NO: 26902 - DNA, 2763 bp, Homo sapiens
gggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttaccttatttgaattgtcattataattttatatgcaaccttaatttgtcaagtaaatactttcatttaatttgaaagaattcatattcatttgctctttcatttgacaataataaaatttaaggtttattacctggaaagagtgcaagaaaatactaaacaactttatcaaactgattcacactgaggggaggttattttgtaacaaataatggaccacaagttcattttgtattcttctgtagtagaggctactgatatgaatttaagaaaaaaccttagaatcttaacttttcacatctgcagatgcagtgtgccattctgaatttttcaatctaagggatgtggatacatagaatgtttaaaaagataacaattagaatgaaaaattaaaattatgtatgcttttatatgggttactttttattgatcacatttctctggaaatttttctttatattttttcacagttgtctttctagctactgaaaaaattatacaaatatctttggccatttaaatgtttatcattgtgcagtgaactgttttagtaactttctgtttgacctttttagaaggttgcatccttaaaatgtgaaccagatacatggctttgcattgaagaggaaagcagtagaatgtcaggttactttaggcagtgtgacagtatataaatgaaatgtggaggatggtggtaacaatttgattttccacacagcaaaaccacagtcccgccacctaacaaagccctgtttatgccacacaccagcatctgagggaagaggaggcactgtgacaaagcagcgctgatgctgctcagcctgcgatgattacagctcatctgcacagccatctgaaagtttaatacatactcatcagagggaacatgccgggacaattttgggttccaatacaaaagttaagcatcaaacaggtttttctttccatttgattaaatgtgctgattttattttactgttgcattagaaacaaacaagttatctttcgctatttaattttccctctatgcaaattgtgttattacagctgaccgctatcagtaaatcttaattctgtcagtcccattgcttccttttttataaaaatactgtgtccccctttactgtcatgaagtgaaattcataaatatatttcctacacatataa

SEQ ID NO: 26903 - DNA, 805 bp, Homo sapiens
ccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccagatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaa

SEQ ID NO: 26904 - DNA, 782 bp, Homo sapiens
agagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaaccc

SEQ ID NO: 26905 - DNA, 8317 bp, Homo sapiens
tttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgtgttgtttttgagatttgtcatttaaggtaccagtgcacacttgatcatatttcattactatctctaacacagtcctaacatctcaaatttaaagaccagttgaagattaagggatttttatcctttgttgaaagtcatgttgggttatttgaaattcaaattttaattgtgctgcccatatatgaaaatgagactgctgactcgctatctatggacatgcactttatgttggtttcttagtagtaagagtaacttcatgataaccccagtcttcttgcctaatttcttttttgagactagctggggttaggattagaatgactatggagcagatatttgttcttctgggaaaagctttaacaggccaaaatagggattgaacttgtccttggcctttatcaaagcaagctagctacccagacgtagtcaaatactctacaaaataaacaagtctgctttaggaattgtctgggtaccttcactgttaccaacttagctgtaaagattatttcaaagctcactcttccatgatttcttctggctttcaatcctatctaagtatcaaggaaattaacttgtaaatatggtagttgtttactaaggatatgtactgctcttgcaaggaaataatgtccaaacaaagcttcacttattttttttaatataagcagatttcactgtttatggcgcttatgtaatacattttatctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaa

SEQ ID NO: 26906 - DNA, 3478 bp, Homo sapiens
tttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctaagcagagtgaagaaaactaaaatccagtttattgtatttcaatactatgtcataacagtcaggtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgt

SEQ ID NO: 26907 - DNA, 4744 bp, Homo sapiens
gcttcctgcgcccgccgcggcccttcccggggcgccgccgccaccgcctggtgtgcgaggctatccggcccgggcccggggcttgcagggtgccagtgggggcgcccggttcccttcctcgctctctcttccagtccccggaaagggtgggtgggtggtctcccgagcgaagtttccagcactggattcctgcgaaattacgacggctcacccgcgtctgtgttttgctgtctctcccccgttttcctgctccctgcctcttccctcccttttcccccactctccactcctcggaaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttatatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacctctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaaaaaaaataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacattggaaatctt

SEQ ID NO: 26908 - DNA, 1172 bp, Homo sapiens
ggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccaagttccatcaccctgtcaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttggaa

SEQ ID NO: 26909 - DNA, 786 bp, Homo sapiens
agaaggttctgggaagtaggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccct

SEQ ID NO: 26910 - DNA, 521 bp, Homo sapiens
ctctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaa

SEQ ID NO: 26911 - DNA, 664 bp, Homo sapiens
gcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccggatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaa

SEQ ID NO: 26912 - DNA, 1457 bp, Homo sapiens
cgggaaagcggaggcggggcggaagggtgcggcgaggcggaatggcggcggctgcggactcgttctcaggcggccccgcgggggtgcggcttccgaggtcgccgccactcaaggtgctggcggagcagctgcggcgcgacgcggagggcggcccgggcgcgtggcggctgtcacgggcggcggcgggccgcgggccgctggacctggcggccgtgtggatgcagggcagggtagtgatggcggaccgcggcgaggctcggctgagggacccgagcggggacttctcggtccgcggcctggagcgggtgccgcgcgggcggccctgtctagtcccaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacctctaataaatttttaataggctg

SEQ ID NO: 26913 - DNA, 1193 bp, Homo sapiens
atgaaacagacccaagtgggctcgctcttcagtctcggcataaggaatccggaacctgggcccgtgtccggaactgctgtgcccaggcagcttgcctggaaatcaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattatt

SEQ ID NO: 26914 - DNA, 6051 bp, Homo sapiens
agtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctg

SEQ ID NO: 26915 - DNA, 6250 bp, Homo sapiens
agtgacgtaagcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctgaca

SEQ ID NO: 26916 - DNA, 1343 bp, Homo sapiens
gtaagcagacacgcgtggcgcgggccgccgtttccgcaaacagaatcgcgtttggctgtgctgaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggacttacggtaactattatgagggaggcatggctttc

SEQ ID NO: 26917 - DNA, 1825 bp, Homo sapiens
gtggcgcgggccgccgtttccgcaaacagaatcgcgtttggctgtgctgtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaact

SEQ ID NO: 26918 - DNA, 939 bp, Homo sapiens
gcgggccgccgtttccgcaaacagaatcgcgtttggctgtgctgaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgct

SEQ ID NO: 26919 - DNA, 1884 bp, Homo sapiens
tggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaa

SEQ ID NO: 26920 - DNA, 1130 bp, Homo sapiens
atgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataag

SEQ ID NO: 26921 - DNA, 2162 bp, Homo sapiens
gctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 26922 - DNA, 2011 bp, Homo sapiens
gctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctg

SEQ ID NO: 26923 - DNA, 3151 bp, Homo sapiens
ggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgc

SEQ ID NO: 26924 - DNA, 3108 bp, Homo sapiens
gtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 26925 - DNA, 3747 bp, Homo sapiens
gccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctg

SEQ ID NO: 26926 - DNA, 2828 bp, Homo sapiens
attggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 26927 - DNA, 1426 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 26928 - DNA, 372 bp, Homo sapiens
gacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtatggttccgaccggcgtttagccgagc

SEQ ID NO: 26929 - DNA, 4244 bp, Homo sapiens
gcgcgcggggggcggggctccccccggctgttcactcagctaccacagcgacgtaaaatggtgtccgctaggcgtcccaggacggcttcctgagggactggagggccccgacagccggaaagcctgccccgccccttggccggcacaggtacgacggcggggagctcagaagtttcgaactccaagggccgaagcacagccaaacaccccacggaacttaacaaatgtttgtggggagaacgccgaaaacgcggggaggcggggctggcgcacagtcaccctctcgcgacatctaagtgacgtcgcacagcaagcacgtgttctagtctttcaccttcagtcagcctcctccgttatacaggcctacccctttaagcgagtgatggacagttatttcagcctatcaacttccttgccgacatccaatcagatttaaacttcttttagccgccggaggagttggaaaaagggggtcgaaagagggagcttaccgtctctcgcgatatcgctgtgagcctgcctctctggaaaaaacgccgaaactgatggcccgacctcccaaatagtggtttaaaggacgggtttataagccaatgaaagggataaggaggtgggttgctgctgtcactgagcaagaagtaccgttacagggcagactttttgtccaatcaacacctcaacactttgggtcacgtgaccgcagagtgcgaggggcggagctacagtctggcgcgaggaaccgttaagatagacaacaaatgtaaccaatgaggtactccgactagggggttgggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaa

SEQ ID NO: 26930 - DNA, 6600 bp, Homo sapiens
gtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgtgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacatt

SEQ ID NO: 26931 - DNA, 1669 bp, Homo sapiens
gagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggattttt

SEQ ID NO: 26932 - DNA, 1116 bp, Homo sapiens
cgccgccgctgtgagaaacctacgggccgcccgcccgccgcgccagcgccatgaagcggcaaagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgca

SEQ ID NO: 26933 - DNA, 2446 bp, Homo sapiens
gccgccgctgtgagaaacctacgggccgcccgcccgccgcgccagcgccatgaagcggcagagcgagcgagactctagcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgca

SEQ ID NO: 26934 - DNA, 3192 bp, Homo sapiens
gcaggcgcaggcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgtaaagtaagttggggttaaggaatgtgaggtaaattacataattgaacattgtggaagacagaatcaaaagcagccctggaacttcagttatctatggaattaggcataccattcctcaagtggaaaccatgtttgtgcttacaagtaccggagtgtgcttgtttaattttagaaactaatggttccaacccacctttcatgcatgcatttattgttgttatgctttgtaaaacattgtttgcacctaaatgggtggcttttcctaacattctcatggtcagcaaccagagagttgcaaccaactcatactacttgatttccgttcgcatgaggacagcttggtgtgtgcctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggc

SEQ ID NO: 26935 - DNA, 2755 bp, Homo sapiens
caggcgcaggcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaa

SEQ ID NO: 26936 - DNA, 792 bp, Homo sapiens
aatggtaccaggagcctgggcctctgttgctgaaaggtcctggaccttttacctctaaaatttcatgatacttattttaacatgaaaagcctttattgaattgtgcattctttaatccccaccccttttgcctttcagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctccccca

SEQ ID NO: 26937 - DNA, 805 bp, Homo sapiens
gaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaagcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctc

SEQ ID NO: 26938 - DNA, 844 bp, Homo sapiens
gcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaa

SEQ ID NO: 26939 - DNA, 3751 bp, Homo sapiens
agtccccgcggcgggcgctggtctctccacgcggctgcggcccggtaccctccgcccgccgccgcctctggtgaccctggccctgaccttctccctcttcccttcctcctcctcctcctcatgtctgcctcgggctgtttggtgctgaagagcgtttcttctccgtctcgtgcaccgcatcctgacgaaattgtctggtcaccagaaccgagtagcccgtagcgtgtcccccctggccctgcacggttgcccctctctggggctcggagccggttcctcccggggtctcagaactgggagtgcagacgttggcgtttctcagactccggagctgcccgggacaggaatgcagccctaaccccggcgtcgcctcggctcgtgcagtttgagcggtgtttcagcgctcacgtccgaccccaggcagtctttgagcttcgcctcttgccccgagaatgtgtaatgatcggagaatgcaggtggaatgaggttctgcccctgcttgcaggagtttggtttctgggaaagcaggcgtgaaaacccaggcccgggttgatttgagaaacgcaagtggggtctggaaggacctctcttgagagaggaggtcatgcttatgttgagtcttgaagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgtaaagtaagttggggttaaggaatgtgaggtaaattacataattgaacattgtggaagacagaatcaaaagcagccctggaacttcagttatctatggaattaggcataccattcctcaagtggaaaccatgtttgtgcttacaagtaccggagtgtgcttgtttaattttagaaactaatggttccaacccacctttcatgcatgcatttattgttgttatgctttgtaaaacattgtttgcacctaaatgggtggcttttcctaacattctcatggtcagcaaccagagagttgcaaccaactcatactacttgatttccgttcgcatgaggacagcttggtgtgtgcctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggc

SEQ ID NO: 26940 - DNA, 676 bp, Homo sapiens
ttcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatg

SEQ ID NO: 26941 - DNA, 7233 bp, Homo sapiens
ccgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaatgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaagattatgcctcaaatcttggaacatcatacgtgcccattccagcaaggtcattcactcagtcaagccccacatttcctttggcttctgtggggacaacttttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagaaacccgggaaggccgtggctgccatcatccaggacatccattcccagagggagagggacatgttccgggaagcagacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtgggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggctggaaaagaggaacaggagggcatggaagaaagccctcaatcagtgggcagacaggagaaagaagcagagttctctgatccggaaaacacaaggacaaagaaggaacaagattgggagagtgaaagtgaggcagagggggagagctggtatcccactaacatggaggagctggtgacagtggacgaggttggggaagaagaagattttatcgtggaaccagacatcccagagctggaagaaattgtgcccattgaccagaaagacaaaatttgcccagaaacatgtctgtgtgtgacaaccaccttagacttagacctggcccaggatttccccaaggaaggagtcaaggccgtagggaatggggctgcagaaatcagcctcaagtcacccagagaactgccctctgcttccacaagctgtcccagtgacatggacgtggaaatgcctggcctaaatctggatgctgagcggaagccagctgaaagtgagacaggcctctccctggaggattcagattgctacgagaaggaggcaaagggagtggagagctcagatgttcatccagcccctacagtccagcaaatgtcttcccctaagccagcagaggagagggcccggcagccaagcccatttgtggatgattgcaagaccagggggacccccgaagatggggcttgtgaaggcagccccctggaggagaaagccagcccccccatcgaaactgacctccaaaaccaagcttgccaagaagtgttgaccccggaaaactccaggtacgtggaaatgaaatctctggaggtgaggtcaccagagtacactgaagtggaactgaaacagcccctttctttgccctcttgggaaccagaggatgtgttcagtgaacttagcattcctctaggggtggagttcgtggttcccaggactggcttttattgcaagctgtgtgggctgttctacacgagcgaggagacagcaaagatgagccactgccgcagcgctgtccactacaggaacttacagaaatatttgtcccagctggccgaggagggcctcaaggagaccgagggggcagatagcccgaggccagaggacagcggaatcgtgccacgcttcgaaaggaaaaagctctgatgcttctgcttctgctgctactgctgctgctgcaaggttggaaaggagagcttgctgaagtggggccttcctgattctggggacaggactaaagcctgagaggaaggaaaaccaagcagggcacattgcttgggcttgttcccagagactcagtgaaatgcccctgatatgtctccaggagcaagtcacccaggtgtgtccagcccactgagggtcaccaactctctccctgctgactcttgtttctctcaatctttcaattcgtttttctctcttttcctcttgttctttctctccctccctccttatgtgccaaggatcgtttccttttcacaaaacccaacttctcagggattttcacagtgtttaaattcttggtaggatataacaggtcaggcctagctgagtcaggcaaggaaaaggtttaatggaaactcctgggtcaggcgaacccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatcttcctccagctaaagcagcagttggcgcgggcttaggttgaatgctggcctctctgcaaagcacagctttggctcgagaggcacagctccaggctgtggaaaacagagttgtcttgggggttaaatgagcttatttaagtcaaggaaacatcatctgtccttgattcagccttggtgcctgcactctggggtacaaccacctcacagtaggatggtttttaaatggccccccagttgggggagaagctaaggaaagagaaggctgcagatccaaagagtggcattgaagtttgctgggtgtctgtaggtggaccctttccagctgggcagatagttgagggctccctgggtttgactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttttgagaagaccatatgggggctgctgaaaagttggtatctcaaataaagtctgaagatcacggctcagcccagattgttcccctggccaactccacaggtttgaacctggcattctggacaccagctatgcctcctccatttctcagaaaacctttgatcttgtgtgtctttcttcctactgaagggaattgtgggggcagttctttggccttcttgctgaactttgctggaaatagcccacaatttttatcagaggttagaactgtacattatcagagagactggacactttatcccctagcaaagtgggagaagattttaccagctcattccactccaccctggccttcccccaccccccatccccagcagcatttccatggaaatccagatggtcgtgtagtgttatggctctcttgtgatagactggccttcatattggagagctagggagagcccctgggagggagagagataaggcgctatctgccttcaatcagaaccttcggtttaaaatcatctaagagtctatacttgtgtgtacatacgtatttatttttatttatttttatacaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgt

SEQ ID NO: 26942 - DNA, 7271 bp, Homo sapiens
ccgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaatgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaagattatgcctcaaatcttggaacatcatacgtgcccattccagcaaggtcattcactcagtcaagccccacatttcctttggcttctgtggggacaacttttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagaaacccgggaaggccgtggctgccatcatccaggacatccattcccagagggagagggacatgttccgggaagcagacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtgggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggctggaaaagaggaacaggagggcatggaagaaagccctcaatcagtgggcagacaggagaaagaagcagagttctctgatccggaaaacacaaggacaaagaaggaacaagattgggagagtgaaagtgaggcagagggggagagctggtatcccactaacatggaggagctggtgacagtggacgaggttggggaagaagaagattttatcgtggaaccagacatcccagagctggaagaaattgtgcccattgaccagaaagacaaaatttgcccagaaacatgtctgtgtgtgacaaccaccttagacttagacctggcccaggatttccccaaggaaggagtcaaggccgtagggaatggggctgcagaaatcagcctcaagtcacccagagaactgccctctgcttccacaagctgtcccagtgacatggacgtggaaatgcctggcctaaatctggatgctgagcggaagccagctgaaagtgagacaggcctctccctggaggattcagattgctacgagaaggaggcaaagggagtggagagctcagatgttcatccagcccctacagtccagcaaatgtcttcccctaagccagcagaggagagggcccggcagccaagcccatttgtggatgattgcaagaccagggggacccccgaagatggggcttgtgaaggcagccccctggaggagaaagccagcccccccatcgaaactgacctccaaaaccaagcttgccaagggtctgacagtgatacaagacttgtttcaggatattctctcactccattggagaaaactccaggtacgtggaaatgaaatctctggaggtgaggtcaccagagtacactgaagtggaactgaaacagcccctttctttgccctcttgggaaccagaggatgtgttcagtgaacttagcattcctctaggggtggagttcgtggttcccaggactggcttttattgcaagctgtgtgggctgttctacacgagcgaggagacagcaaagatgagccactgccgcagcgctgtccactacaggaacttacagaaatatttgtcccagctggccgaggagggcctcaaggagaccgagggggcagatagcccgaggccagaggacagcggaatcgtgccacgcttcgaaaggaaaaagctctgatgcttctgcttctgctgctactgctgctgctgcaaggttggaaaggagagcttgctgaagtggggccttcctgattctggggacaggactaaagcctgagaggaaggaaaaccaagcagggcacattgcttgggcttgttcccagagactcagtgaaatgcccctgatatgtctccaggagcaagtcacccaggtgtgtccagcccactgagggtcaccaactctctccctgctgactcttgtttctctcaatctttcaattcgtttttctctcttttcctcttgttctttctctccctccctccttatgtgccaaggatcgtttccttttcacaaaacccaacttctcagggattttcacagtgtttaaattcttggtaggatataacaggtcaggcctagctgagtcaggcaaggaaaaggtttaatggaaactcctgggtcaggcgaacccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatcttcctccagctaaagcagcagttggcgcgggcttaggttgaatgctggcctctctgcaaagcacagctttggctcgagaggcacagctccaggctgtggaaaacagagttgtcttgggggttaaatgagcttatttaagtcaaggaaacatcatctgtccttgattcagccttggtgcctgcactctggggtacaaccacctcacagtaggatggtttttaaatggccccccagttgggggagaagctaaggaaagagaaggctgcagatccaaagagtggcattgaagtttgctgggtgtctgtaggtggaccctttccagctgggcagatagttgagggctccctgggtttgactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttttgagaagaccatatgggggctgctgaaaagttggtatctcaaataaagtctgaagatcacggctcagcccagattgttcccctggccaactccacaggtttgaacctggcattctggacaccagctatgcctcctccatttctcagaaaacctttgatcttgtgtgtctttcttcctactgaagggaattgtgggggcagttctttggccttcttgctgaactttgctggaaatagcccacaatttttatcagaggttagaactgtacattatcagagagactggacactttatcccctagcaaagtgggagaagattttaccagctcattccactccaccctggccttcccccaccccccatccccagcagcatttccatggaaatccagatggtcgtgtagtgttatggctctcttgtgatagactggccttcatattggagagctagggagagcccctgggagggagagagataaggcgctatctgccttcaatcagaaccttcggtttaaaatcatctaagagtctatacttgtgtgtacatacgtatttatttttatttatttttatacaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgt

SEQ ID NO: 26943 - DNA, 2342 bp, Homo sapiens
aagaagccctagacgcgtaaataagacgccgaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 26944 - DNA, 1386 bp, Homo sapiens
caattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataa

SEQ ID NO: 26945 - DNA, 2128 bp, Homo sapiens
gtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatggaaagggaaaaatcaggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 26946 - DNA, 4426 bp, Homo sapiens
tggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttt

SEQ ID NO: 26947 - DNA, 541 bp, Homo sapiens
agaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaag

SEQ ID NO: 26948 - DNA, 2470 bp, Homo sapiens
ctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 26949 - DNA, 1567 bp, Homo sapiens
cgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 26950 - DNA, 3375 bp, Homo sapiens
gaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggggtctttctctgtctctcagcctcaagccatcctcctgcatcagcctcccaagtagttgggaccatagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtcctt

SEQ ID NO: 26951 - DNA, 1039 bp, Homo sapiens
aagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggacggagtcttactctgtcgttcaggttggagtgcagtggcgcgacctcggctcactgcaacatctgcctcccaggttcaagcaattctcctgcctcaccttccagagtagctgggattacagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggac

SEQ ID NO: 26952 - DNA, 1093 bp, Homo sapiens
agtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaa

SEQ ID NO: 26953 - DNA, 2808 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaat

SEQ ID NO: 26954 - DNA, 2251 bp, Homo sapiens
accaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagc

SEQ ID NO: 26955 - DNA, 2382 bp, Homo sapiens
gcagcgccggtcgggagcgcagcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 26956 - DNA, 760 bp, Homo sapiens
ataaacatcagcttaagtaaaaacgtcttgaagacactttcctgcttaccttccaagcatagcgtcgcaaactccttctcagaggaaagtctcggccctcactggtgggcaagtccaggcggccccccaagctcccttcggggttcatttttgccctatccccgcaggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgcc

SEQ ID NO: 26957 - DNA, 686 bp, Homo sapiens
gcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcc

SEQ ID NO: 26958 - DNA, 1694 bp, Homo sapiens
actttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 26959 - DNA, 1763 bp, Homo sapiens
actgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataa

SEQ ID NO: 26960 - DNA, 2321 bp, Homo sapiens
accttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 26961 - DNA, 1548 bp, Homo sapiens
gttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaatta

SEQ ID NO: 26962 - DNA, 757 bp, Homo sapiens
aggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggactta

SEQ ID NO: 26963 - DNA, 1337 bp, Homo sapiens
agagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaagataacccctgtgacagaaggctactgttgctgtaacaaagggcatacatacattttcaagaactgcaatttaattttggagtccaggaaaagcagaagatgctgagatgtcatatatggcgaattgcactattctaaatgtgttttgttttaatctttcacagtaaacaagctttcagaaatgatggtcacaaggggtaggatatcaaggagcagccagtcattcacccaattccaacacacctacatgtcacactgtcacagagtgagagccacagttccagtagttcccctaattgaccaaatctcccttgccaaatcaaaagaaatcattcctagaattctctaatccttctattgatgatgggaactccagacaccaatggctgggggaaaaaaaaagttaactcacaccaagttcctctacttattacagacaaagggccaaatcttggtcttgatctgtgccaatcgacttcaaaagttgtgacgttcttggatcagttctgctagggtgagacccgaatttggatccccaacagttctggagtatttcatcctggcagcctcattaacatcaggctcctgggactgcaaccaactcagggttattcagtccatttgaggttcacacctggaaggtaagtttctttaaaagtcatcgctaaaaagaggttagttgaacaaccactgcttgcagtcaaaattcattttaaaatgtcctagcaataccttttgaagaccacaatatatgaatttaatatttaactttgaaacataagagacaggttatctgatagatttataccagcttacttcggaa

SEQ ID NO: 26964 - DNA, 921 bp, Homo sapiens
gttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 26965 - DNA, 1649 bp, Homo sapiens
ggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcc

SEQ ID NO: 26966 - DNA, 1562 bp, Homo sapiens
ggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcc

SEQ ID NO: 26967 - DNA, 4243 bp, Homo sapiens
agatcgggttcaacggcagggattgggtaaggtgagaatctggcttggcggctccggccccggccatctggttcccttgggctccggccgccaccatccactcgacggctctcggcccgaacgcttggtcgcaccgcctgccgaggtcctagatgaatcgcttcaggcctggaaacgaggaagccgtctccggagaccatcgccaacgctgacgcccgcggtctgaggtcgccatgggaagagcggtaggccaccctgctcctctgatcaccggaggacagggacacattgttcagggccatattcaaacactgcccgcagtacttgcgttacgtccctttgtgaaggcaggcccttcgcggctccccagatcagtccagcctgtgtcggacccgatgactaagcacacaggaacccataactgagcctgcggaagagccagaagccgccttgcctttaacgaggggtatcctggcgagcatgcgcagaccgtccgcgcacgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctga

SEQ ID NO: 26968 - DNA, 2827 bp, Homo sapiens
ccctctgcgacagtttcccgaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgct

SEQ ID NO: 26969 - DNA, 796 bp, Homo sapiens
gagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttct

SEQ ID NO: 26970 - DNA, 2215 bp, Homo sapiens
aacagccgaccaatcacaggcagcaggggcgcgccctgcagcggggctccggctgcggttccgtggactcggcgactaggcgccgcctgaccagtaggagccgccctcgacgagcgagctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacacggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatctatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttc

SEQ ID NO: 26971 - DNA, 1767 bp, Homo sapiens
atggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgc

SEQ ID NO: 26972 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 26973 - DNA, 1885 bp, Homo sapiens
cagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgc

SEQ ID NO: 26974 - DNA, 1547 bp, Homo sapiens
gagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatg

SEQ ID NO: 26975 - DNA, 1598 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaactta

SEQ ID NO: 26976 - DNA, 2757 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccagggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 26977 - DNA, 1864 bp, Homo sapiens
atcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgcca

SEQ ID NO: 26978 - DNA, 8208 bp, Homo sapiens
tttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgacatggccggaccagttctttctttgttgtttgtttaaactaccttccactggtgttttacatagtgcaaaaaaaaaaagagggtggggggagttgtctctcttttctttaaatgtgtattcattgatagcagaagcttgtacctgctgtgtttagcagtttcagcatgaagagttctggatatgaactgattcatagagccaagtggctttaaattctgtgagcttttctggtttctcactagctgtcttgaatagtgaaacctgtattgatggccactagtaaaccaagatgcttatttaacaggtggaatattctttatatgaaatttcagctaaagacactttctggacctggtctgaaaggtcatttgtcaaaaaagcttagggatattctgtgaaatggtgagtggtctcctggaaaggtctcattgtatttgaacaatagtcttccctctaaattacaacacctctgggttttgtctttacacctctgtctttgtcatcacctaccatgaatagtcaccttggttttgcaaatggggagggggtatcatctttttgcctgttttcactgtatttttgtatattggtgttgccgaaagaactttttctttcagtttaattctttgaggcatgtaggaccaataagattgagaattctattggtggaatttagggaagtccttaaaatgctagttgacaatcaaggaacagtatgatttatatcaataagaaccaaaagaattaggtttgatcaatcatttaagccaaggaggaatacttgcatttagaacaatgcaaaactttgtctaaaatgaattaaattgacccacctgtaaaatatatctacatttttaattcatgagatgatatgtgttcaacctttacagttttacctgaaattaaggacaatggaatagaatttgttaagtgaaccattcactagattgctttctgaatgaatcctttgaatcaaataggtgaaactcttttcaaaaactaagtcagtcacaggagcctgtcttagtccaaaagaagcagggaaatgtatttaagtgtactataaaacagggtaggctttttaaaaactaaaaagttttaaaggtaaatcatattcccattaggtcaacatgagtaataaggttgactcatgtgaaattgtcaatattctactatttctgtaaactctggttctcttatttgcaaccccatgcactggaagcccaaatcagagaatgactccatatatttatggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaagaaaaaaaatagaaggaaaacaacggcacatactcaaatttgccctgctttgtctgttgtcttacctaagacttgttttgaagagccaagtctgggagagaaaaaaaagcatcaacaggtaagcagcattacattgtgtggtaataaaccaaaataagttttcaatatatacagacaacagaattcaaatttaatcaacaaaatatattgtagtgatttgtttgtttgtttgtttgagacggagtctcgctctgtcgcccatcctaactaggactataatctttttttttttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattgaatagg

SEQ ID NO: 26979 - DNA, 3278 bp, Homo sapiens
acgctgctccctggagaggctctctcggttccacccaccggctggaaggaggggaagtgaatgaaaggacaggacaagccccgaacaccatgtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 26980 - DNA, 1394 bp, Homo sapiens
agctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcc

SEQ ID NO: 26981 - DNA, 2974 bp, Homo sapiens
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 26982 - DNA, 3110 bp, Homo sapiens
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 26983 - DNA, 1341 bp, Homo sapiens
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactc

SEQ ID NO: 26984 - DNA, 2941 bp, Homo sapiens
gggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtcacacca

SEQ ID NO: 26985 - DNA, 2819 bp, Homo sapiens
ggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctat

SEQ ID NO: 26986 - DNA, 3268 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 26987 - DNA, 4099 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 26988 - DNA, 4021 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 26989 - DNA, 3321 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 26990 - DNA, 1530 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 26991 - DNA, 1513 bp, Homo sapiens
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 26992 - DNA, 3524 bp, Homo sapiens
aagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaa

SEQ ID NO: 26993 - DNA, 2277 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaa

SEQ ID NO: 26994 - DNA, 974 bp, Homo sapiens
gcggcgtgtgcgcctccggggctgctgattagaataggggacttggccgtggatggaatccgggaaacccaaaccggagatggaaggatgaggctgcgtttgcagcgcgtgaatgggacgcggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 26995 - DNA, 2196 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaa

SEQ ID NO: 26996 - DNA, 4394 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattagc

SEQ ID NO: 26997 - DNA, 2017 bp, Homo sapiens
ccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtatgtttgttcattttcagtgtacttttcctggatgttctcttatctagaatccatcaaaaccttgctaataataatcaacatataaaaatatcgtgttccagcactttgggaggctaagacaggtggatcacttgagcccaggaggttgagaccatgctgggaaccctgtctctacaaaaagaaaaattttttgtcattagccaagttcagtggcatgtgcctatagtcccagctactctggaggctgaggtgggaagatcacttaagccccatgagtttgaggctgcagtgagccgtgatcacaccactgtactccagcctgggtgacagagtgagaccctgtctcaaaaaaaaaa

SEQ ID NO: 26998 - DNA, 4434 bp, Homo sapiens
tgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattagcataa

SEQ ID NO: 26999 - DNA, 2082 bp, Homo sapiens
agctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgc

SEQ ID NO: 27000 - DNA, 2180 bp, Homo sapiens
gcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatct

SEQ ID NO: 27001 - DNA, 1809 bp, Homo sapiens
gccgtcacgcgcaccgtacagcccagtccacgaagggcgccacgggccgtgacgtcactagccgccgacggcgcgctttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagattacgtta

SEQ ID NO: 27002 - DNA, 4672 bp, Homo sapiens
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcgattcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacgaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatgcagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtactgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaa

SEQ ID NO: 27003 - DNA, 3110 bp, Homo sapiens
ccggcgtcttagcccgctcttctggccccgccccgcgctacgcgtagggaggcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaata

SEQ ID NO: 27004 - DNA, 1778 bp, Homo sapiens
ccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattcctactcaatgtgaagacaaggataaagacctttatgatgatctacttccacttaatgaatagt

SEQ ID NO: 27005 - DNA, 2332 bp, Homo sapiens
gcttgtggggaagcgcaggaggcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 27006 - DNA, 2149 bp, Homo sapiens
cggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaagaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatga

SEQ ID NO: 27007 - DNA, 2133 bp, Homo sapiens
gagtcactgccgggctcggcgtgagtcgctgcggggctgacggggtggcagtgcggcgggttacggcctggtcagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgag

SEQ ID NO: 27008 - DNA, 7492 bp, Homo sapiens
aattgagctggagaggaggcagcgtgagagcagaaacttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagctccttcagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 27009 - DNA, 4965 bp, Homo sapiens
atgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaaggtaaagtaaatgaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaccttcatca

SEQ ID NO: 27010 - DNA, 7510 bp, Homo sapiens
aattgagctggagaggaggcagcgtgagagcagaaacttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 27011 - DNA, 6742 bp, Homo sapiens
aaagttgcagggctgcgtctgcactacggagcctctagattgctgaaaacagtcttatggaaggataacacattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 27012 - DNA, 4841 bp, Homo sapiens
gtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcaga

SEQ ID NO: 27013 - DNA, 5600 bp, Homo sapiens
tcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttgg

SEQ ID NO: 27014 - DNA, 3210 bp, Homo sapiens
atggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgaggtggagttatagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttct

SEQ ID NO: 27015 - DNA, 1722 bp, Homo sapiens
aaaaagaccatgagtacagatgaaggcacctatatgtgtattgctgagaatcgggttggaaaaatggaagcctctgctacactcaccgtccgaggtggagttatagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaaataacacaggctaccccatatgccacgacacagatcttgcattccaacagcatacatga

SEQ ID NO: 27016 - DNA, 4182 bp, Homo sapiens
atggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaatta

SEQ ID NO: 27017 - DNA, 8946 bp, Homo sapiens
ggcgaggggcctcagcgcgcctggcgctggactgagcgctccctttctccgccgcgcccgggctgggctctcacgcccgtctctgctcgcgcccgcagccgcctggtgcactatcctcagaggcggcaccgcgggggtgtctgcagcctcggcctccgcccggcccctccctccctccctccctccctcgctccttccctgcctccctcaccacgtaggagttcggattctccacccgaatcgtcctgatttcccttctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 27018 - DNA, 8372 bp, Homo sapiens
cgctggaggagggaggcggaaggacagcgctgcgccaccacccggaggagggagcgcggtagctgcaggcaggggagggagaggaaagaaaaggaaggacggctcccagacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaa

SEQ ID NO: 27019 - DNA, 4569 bp, Homo sapiens
ggagagaaggacgagggaaggaggagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacgggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 27020 - DNA, 4551 bp, Homo sapiens
tcgccaagcgtggttcagccactcccgcttaaacttggcaggagaggagacggaggtctctaggtggtccagaaagccggcctagaagtttgtgtcccgatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 27021 - DNA, 1520 bp, Homo sapiens
ggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatc

SEQ ID NO: 27022 - DNA, 4710 bp, Homo sapiens
acttcactcagcctccccagcctgcagccccactgccctctgtcttcagcttcttgctgtgtcctgagactcctggggttttcactcttctctagcaggtgtcaaagggataaggattgggatccagggataagatttaaatagaggattaaggctctgatcggagttttggttagtgtaaggataccctgtaagaaatccccgagtagatcatgagataaagcttagcgctgaagttagggtcgggggttatagctaaatggtcgaggtcagagagtttctcgcctctggtctcctcccagttctccaaggcactgagggccaggcaggaagcatcggtttcctcaaagccgcttccctcctggggcagagtctcggtcacaaacaaccaccaccggcccaccccgcccctccttccctcttcactgtgagctcagagcagcaggacaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 27023 - DNA, 3932 bp, Homo sapiens
aaagtgctcgggacaaggacatagggctgagagtagccatgggctctggaggagacagcctcctggggggcaggggttccctgcctctgctgctcctgctcatcatggtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 27024 - DNA, 3071 bp, Homo sapiens
cttccctcttcactgtgagctcagagcagcaggacaaagtgctcgggacaaggacatagggctgagagtagccatgggctctggaggagacagcctcctggggggcaggggttccctgcctctgctgctcctgctcatcatggccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagc

SEQ ID NO: 27025 - DNA, 5936 bp, Homo sapiens
gcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctggagaccacaaacatctgcagactaaacctctccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagtttt

SEQ ID NO: 27026 - DNA, 6176 bp, Homo sapiens
gcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgagacttctcctcctcctgaagataggaaggaaatttcaccagaggtagagcatataccagaaatagaaattaatatgctgactgttccacatgttcccaaggtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagagtctcgcattgtctcccgggctggggtgcagtagcgcgatctcagctcactgcaacttccgcctcccgggttccagcgattttcctgcctcagcctcccaagtagatgggattacaggtgcctgccaccacacccagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctggagaccacaaacatctgcagactaaacctctccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagtttt

SEQ ID NO: 27027 - DNA, 3759 bp, Homo sapiens
cgcaacttccgggacagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 27028 - DNA, 2039 bp, Homo sapiens
acagaaatgagctcattcctcctaactgggtaatagacatgggtggggcctggaaaagatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctg

SEQ ID NO: 27029 - DNA, 2198 bp, Homo sapiens
gcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaagagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggt

SEQ ID NO: 27030 - DNA, 1557 bp, Homo sapiens
acaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcag

SEQ ID NO: 27031 - DNA, 2985 bp, Homo sapiens
gcgaccggccagagtagggcatccgctcgggtgctgcggagaacgagggcagctccgagccgccccggaggaccgatgcgccgggtggggcgctggccccgagggcgtgagccgtccgcagattgagcaacttgggaacgggcgggcggagcgcaggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactggtgtttgtcaactgtaaggactcatggaacagatctaccagggattctcagaccttagtttgagaaatgctgcaattaaaggcaaatcctatcactctgagtgatcgctttggtgtcgaggcaatcaaccataaagataaatgcaaatatggaaattgcataacagtactcagtattaaggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 27032 - DNA, 2320 bp, Homo sapiens
cgcgccctcgcccctcccgggcctgcccccgtcgcgactggcagcacgaagctgagattgtggtttcctggtgattcaggtgggagtgggccagaagatcaccgctggcaaggactggtgtttgtcaactgtaaggactcatggaacagatctaccagggattctcagaccttagtttgagaaatgctgcaattaaaggcaaatcctatcactctgagtgatcgctttggtgtcgaggcaatcaaccataaagataaatgcaaatatggaaattgcataacagtactcagtattaaggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgct

SEQ ID NO: 27033 - DNA, 2692 bp, Homo sapiens
attccctccctggtgctcgcagaggactggcccctctccgggctgggagctccggccgagcggaggcgcgacggagagcaccagcgcagggcagagagcccggagcgaccggccagagtagggcatccgctcgggtgctgcggagaacgagggcagctccgagccgccccggaggaccgatgcgccgggtggggcgctggccccgagggcgtgagccgtccgcagattgagcaacttgggaacgggcgggcggagcgcaggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattcttaggcgtacggccagggctattggttgaatgagtaggctgatggtttcgataataactagtatggggataaggtcagctataaaggaggactttccatctgggagaggcagaatctatatactgaagggctagtggcactgccaggggaagggagtgcgtaggcttccagtgatggttggg

SEQ ID NO: 27034 - DNA, 2462 bp, Homo sapiens
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggataaggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 27035 - DNA, 2402 bp, Homo sapiens
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgagtcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattcttaggcgtacggccagggctattggttgaatgagtaggctgatggtttcgataataactagtatggggataaggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 27036 - DNA, 3111 bp, Homo sapiens
acttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatt

SEQ ID NO: 27037 - DNA, 2957 bp, Homo sapiens
agcctagacttagatgccttggaccacagcaccacctacttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtgggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 27038 - DNA, 2748 bp, Homo sapiens
gcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtgggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 27039 - DNA, 2487 bp, Homo sapiens
cttttttctggaaactgcgacgagatgggaactttctgaattaagcagcaattcccgcgctggttttctggggagtcctcgcctccagagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 27040 - DNA, 674 bp, Homo sapiens
acctcactgttttagtatctgtgagacacagatgtgaaagctacagatttaattaacatgcagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttc

SEQ ID NO: 27041 - DNA, 579 bp, Homo sapiens
atttcttggcctgggttgaggaccttgccctaagttctacctctgtctggtctgacatccccatgagccattcagctttagcttctggcctcaactctgcctctgagtttcctctttgtttctaagtttggttgtgtattaacaactttttgggtggaggaggtagagggaagaaggggagggatattttatttagtatttctatctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgt

SEQ ID NO: 27042 - DNA, 562 bp, Homo sapiens
acaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagag

SEQ ID NO: 27043 - DNA, 568 bp, Homo sapiens
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattc

SEQ ID NO: 27044 - DNA, 2707 bp, Homo sapiens
cacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccagggggagtgtgaactgggtccctggggcggctggagcccctgcacacacaatggaaagacctgcggctcggcttggggcctggagagccgggtacgagaggctggccgggctgggcatgaggaggcagccacctgccaggtgctttctgagtcaaggaaatgtcccatccagaggccctgcccaggagagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctccatttgtcctctctttctttccacccttctatcatttttctgtcagtctaccttccctttctttttcttttttatttcctttatttcttccacctccattctcctctcctttctccctccctccttcccttccttcctcttctttctcacttatcttttatctttccttttctttcttcctgtgtttcttcctgtccttcaccgcatccttctctctctccctcctcttgtctccctctcacacacactttaagagggaccatgagcctgtgccctcccctgcagctttctctatctacaacttaaagaaagcaaacatcttttcccaggcctttccctgaccccatctttgcagagaaagggtttccagagggcaaagctgggacacagcacaggtgaatcctgaaggccctgcttctgctctgggggaggctccaggaccctgagctgtgagcacctggttctctggacagtccccagaggccatttccacagccttcagccaccagccaccccgaggagctggctggacaaggctccagggcttccagaggcctggcttggacacctcccccagctggccgtggagggtcacaacctggcctctgggtgggcagccagccctggagggcatcctctgcaagctgcctgccaccctcatcggcactcccccacaggcctccctctcatgggttccatgcccctttttcccaagccggatcaggtgagctgtcactgctgggggatccacctgcccagcccagaagaggccactgaaacggaaaggaaagctgagattatccagcagctctgttccccacctcagcgcttcctgcccatgtggggaaacaggtctgagaaggaaggggcttgcccagggtcacacaggaagccttcaggctctgcttctgcctgatggctctgctcagcacattcacggtggagaggagaatttgggggtcacttgaggggggaaatgtagggaattgtgggtggggagcaagggaagatccgtgcactcgtccacacccaccaccacactcgctgacacccacccccacacgctgacacccacccccacacttgcccacacccatcaccgcactcgcccacacccaccaccacactgccccacacccaccaccacactcccccacacccaccaccacactcgcccacacccaccaccagtgacttgagcatctgtgcttcgctgtgacgcccctcgccctaggcaggaacgacgctgggaggagtctccaggtcagacccagcttggaagcaagtctgtcctcactgcctatccttctgccatcataacacccccttcctgctctgctccccggaatcctcagaaacgggatttgtatttgccgtgactggttggcctgaacacgtagggctccgtgactgggacaggaatgggcaggagaagcaagagtcggagctccaaggggcccaggggtggcctggggaaggaagatggtcagcaggctgggggagaggctctaggtgatgaaatattacattcccgaccccaagagagcacccaccctcagacctgccctccacctggcagctggggagccctggcctgaacccccccctcccagcaggcccaccctctctctgacttccctgctctcacctccccgagaacagctagagccccctcctccgcctggccaggccaccagcttctcttctgcaaacgtttgtgcctctgaaatgctccgttgttattgtttcaagaccctaacttttttttaaaactttcttaataaagggaaaagaaacttgtaaa

SEQ ID NO: 27045 - DNA, 722 bp, Homo sapiens
gcccacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccaggagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctcca

SEQ ID NO: 27046 - DNA, 5021 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaactgtaccaatattgtaaataaatgttatgccattttaacaaaggga

SEQ ID NO: 27047 - DNA, 5199 bp, Homo sapiens
gccgccgccgccggcgcggaaggacgaggctgaggcgagaaacgaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctcc

SEQ ID NO: 27048 - DNA, 5636 bp, Homo sapiens
atcttccctgagatgcctaaggacaaaagaggagctagacacaactctccccatttttcctttgctgtcttaagagtgctccatcttccagcactgactgccctctgtggctggctcctttctctaccctcccccttccctaggctaaagggcccacaggggctggaagggagggaggctgagtggctgtgctgtgggcctgcctgctcctttcccttcccccttcccttagcagcaacgtcaccgcagcaccagcagccgcggcagcagcacggagactggggctgggattgcgcagcctccctgcattagcaacgatgccattgtattagcagaaatcagatcttaggaaatcggcccagttcccctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaacca

SEQ ID NO: 27049 - DNA, 3101 bp, Homo sapiens
agcaacgatgccattgtattagcagaaatcagatcttaggaaatcggcccagttcccctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggactggctgagcctggacaagtccatgttccaactagtggcgcagacagtgggttcccgccgggagccagagcccaa

SEQ ID NO: 27050 - DNA, 1821 bp, Homo sapiens
acggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctca

SEQ ID NO: 27051 - DNA, 2032 bp, Homo sapiens
gggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgag

SEQ ID NO: 27052 - DNA, 1761 bp, Homo sapiens
gcaaattgccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 27053 - DNA, 1641 bp, Homo sapiens
atggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaac

SEQ ID NO: 27054 - DNA, 1488 bp, Homo sapiens
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgc

SEQ ID NO: 27055 - DNA, 2488 bp, Homo sapiens
atcatggcaaccgttgtaagtgtgggtgcatggagggtgaggagcgagctagcagtctcgagtttgagagaggaggatgctggaggccctgactcctgggtctgagggaggggggatctgggggttcagactcctgggtctgaaagaggaggaagctcggccacccagatctgggggagaaggggacatgggggctggacttctggatctgaggcggggagggggctgggatcccagaatctcgggtctggccccatcatgctataggaactccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtacctgttcagtgtgtctgagagcgcgagggcgcctagtgagcctttagtgggaagaaattgtcgaggaacaagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgc

SEQ ID NO: 27056 - DNA, 2009 bp, Homo sapiens
gtgtcccggccccgcctcggccgtgagacctccagggggcggagcttgccgctgcgctttacggaaacgagtggccttcagctctgtcaatctggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacacctccagagtgcggattgagaagcc

SEQ ID NO: 27057 - DNA, 15376 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 27058 - DNA, 15391 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 27059 - DNA, 15376 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtaggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 27060 - DNA, 2200 bp, Homo sapiens
aaacttgctgctctcgtccgccaccgagtctctctctttggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaa

SEQ ID NO: 27061 - DNA, 15033 bp, Homo sapiens
ctgggccctagatcctcatctaacaagctctcaaataaaaagatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaaggggcaactagatatcattaaatggtcatttggtctaaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagtcacaggatcccaacgcagcaaggaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgt

SEQ ID NO: 27062 - DNA, 16562 bp, Homo sapiens
ccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 27063 - DNA, 1425 bp, Homo sapiens
agcttagccatctaattttttagcatgcattggaatcctcagaatttttggttgaataagaatgaattttaaaagtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggaggttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgt

SEQ ID NO: 27064 - DNA, 4343 bp, Homo sapiens
agcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaacacgatattatcaaagatttaagaaacaaatttgccagcctcggcgagaactctctggaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctagttttataaggaacagaagaaaaagaaga

SEQ ID NO: 27065 - DNA, 4536 bp, Homo sapiens
tattgagaaacgatttgcctatagtttcctccaacaactcattcgctatgtggatgaagcccatcagtatatcctggagtttggtcgttcttcctttaattgatcagtatttcaaaaaccatcgtttatacttcttatctgcagcaagcagacctctctgctctggaggacatgcttccaacaaagagaaagaaatggtgactaggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaacacgatattatcaaagatttaagaaacaaatttgccagcctcggcgagaactctctggaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatgga

SEQ ID NO: 27066 - DNA, 16197 bp, Homo sapiens
gatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 27067 - DNA, 15473 bp, Homo sapiens
atggctgagctaggtggtggtggtgaagaggatgcaagatggtacaggaaggaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagaagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtacc

SEQ ID NO: 27068 - DNA, 15559 bp, Homo sapiens
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaata

SEQ ID NO: 27069 - DNA, 15557 bp, Homo sapiens
gcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaat

SEQ ID NO: 27070 - DNA, 594 bp, Homo sapiens
ggactgttgaagacaggtctccacacacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcaccagc

SEQ ID NO: 27071 - DNA, 522 bp, Homo sapiens
cacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgaaagagcttatgctgtaggcaacagaagccctcaagacctttgaggaggcctagaagagtcccataattcaatgcagttcctctcgctcatctttgcctcctgctcctcaaccacccccttgcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcac

SEQ ID NO: 27072 - DNA, 784 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcacc

SEQ ID NO: 27073 - DNA, 236 bp, Homo sapiens
agaacctgctcccacctcaggcccaggccaaccggagccctcaagtccctgccaaggccccctctgtctcccaggtgttgggaagggtcccagccctcccctgcctcgcctcctgtggggtgcactgctgcaatgggctctgagctggagacggcgatggagaccctcatcaacgtgttccacgcccactcgggcaaagagggggacaagtacaagctgagcaagaaggagctgaa

SEQ ID NO: 27074 - DNA, 616 bp, Homo sapiens
actccctgaaggaaaaggagaactgtgccatctcagagggcattttccaagaggaagcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 27075 - DNA, 1202 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 27076 - DNA, 594 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaa

SEQ ID NO: 27077 - DNA, 308 bp, Homo sapiens
accactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaggcctaagaaagggtcttctgtcattgatgaaatattccaaggcctggatgctaatcaagatgaacaggtcgactttcaagaattcatatccctggtagcc

SEQ ID NO: 27078 - DNA, 516 bp, Homo sapiens
aagatgaagcctgaactgattataaaaccttccttggctcagtgcccttcaccactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatgctaatcaagatgaacaggtcgactttcaagaattcatatccctggtagccattgcgctgaaggctgcccattaccacacccacaaagagtaggtagctctctgaaggctttttacccagcaatgtcctcaatgagggtcttttctttccctcaccaaaacccagccttgcccgtggggagtaagagttaataaacacactcacgaaaagtt

SEQ ID NO: 27079 - DNA, 1137 bp, Homo sapiens
aacaaattggtaatcggtggttaaataaatatgcccaaagtcccacagctagaaagtagcagggctggaatttgaacccagtccaataaaacctcaaaaccggtgcactttctaccgtatcctgaggcttctttactttggggccctggttagccttagcagcctagttttctacatccttcatgccagttgaatgaaactactgacatgctccacattcttctttctcccatgcttttgttcattcagttacctcctcctaaaatgtctgcatttacccagataatcttccaatggaaatccatggttcaagtgccacctcttcaggaaagccatctgacttcaatcaggaagccagagagctccgtctgcagcagctctttcagctccttcttgctcagcttgtacttgtccccctctttgcccgagtgggcgtggaacacgttgatgagggtctccatcgccgtctccagctcagagcccattgcagcagtgcacctacccacccccatcatggaagtgagctgaggaccaggcccggagtacctggggtctaggcagcagtggatggtgcaggggaaagaggtgggaaggaggtcctgggagggacactggatgtcttaccccaagctgggccttgcagtacctgtggctggctgtgctggttgagcccgcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaa

SEQ ID NO: 27080 - DNA, 892 bp, Homo sapiens
cggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 27081 - DNA, 547 bp, Homo sapiens
gctgggaggagcggttagagtgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 27082 - DNA, 579 bp, Homo sapiens
gtactaaacccgtcctggagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 27083 - DNA, 684 bp, Homo sapiens
aggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 27084 - DNA, 1017 bp, Homo sapiens
gtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgatt

SEQ ID NO: 27085 - DNA, 1080 bp, Homo sapiens
gaaacccaaggcttttcacccaaatatactgcctgctgtccagagggcacacttaggatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 27086 - DNA, 1218 bp, Homo sapiens
ctctgggccgctgaggggagctgaagggaggtcaggcaaacactcactcaatctgcctccctccatcaggctgcccttctctggcttcctcctgatccaagttctctacattcatctctctgcctccaggactggtataagagctgagctcaggtgagctggctcctcctgtcttgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 27087 - DNA, 1025 bp, Homo sapiens
agatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 27088 - DNA, 557 bp, Homo sapiens
gctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtggggcattccagagaaccatgtgctgtgagggccttccgagtccatctgtttaatcctgtcattggagacttgagaaaccagagcccagaagggaaaagtgattgtcccaagatcacacagcactgggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctg

SEQ ID NO: 27089 - DNA, 998 bp, Homo sapiens
tggcaccagtctccaggccccagagcaggggttgcctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaa

SEQ ID NO: 27090 - DNA, 457 bp, Homo sapiens
ggaggagggtgtgccgctgagtcactgcctgggcatctgggcctggaacctcggccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgata

SEQ ID NO: 27091 - DNA, 453 bp, Homo sapiens
gtgagctcaccatgtgggggtgaggctgagagaaaacaagtacacagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 27092 - DNA, 579 bp, Homo sapiens
aaatggctcaccaaggttgcacagctggcgacaggcagagaggatcccacaagtttttcttctgggtgcagcttcctcgagttcagggcaggaggcaggtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggat

SEQ ID NO: 27093 - DNA, 856 bp, Homo sapiens
ggggaggtgagcaattccaggaagggcttcccctccaatagaacagagtatccctatacagaacctccctgctcaaaacccccaggggtcgggagggtaacctcaggggaggccagtctcagattggtaaacacccgaactggtcaactctcaagagaccatctggttcaggttcctgactgggccagcgagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcatcagc

SEQ ID NO: 27094 - DNA, 566 bp, Homo sapiens
ttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 27095 - DNA, 531 bp, Homo sapiens
tcctttcttgggaggctacaaatagtgacgccctgtctctaagctcctacagctgaaacgccagcaccagtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 27096 - DNA, 573 bp, Homo sapiens
ggccctgggagtttgctgcccgaatctccagagcttgcgcagcggatcttgcaaatgttcactgcccagagcatgtgttccccactgtgcacaccctcccagccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 27097 - DNA, 600 bp, Homo sapiens
agtatccgctctcccctgtcccctgctatgggcagggcctggctggggtataaataggtcagacctctgggccgtccccattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 27098 - DNA, 513 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 27099 - DNA, 710 bp, Homo sapiens
tcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaagggacagagatcagggaaataaaggcagaaggcagtgagagggaggctatgcctgctgcttggattctctgggctcactcccacagtgagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctggga

SEQ ID NO: 27100 - DNA, 506 bp, Homo sapiens
cagccccctctcagccctggactctctctttgccctgtccccgactttaataatgggacactcctcgatatcagagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgca

SEQ ID NO: 27101 - DNA, 710 bp, Homo sapiens; identical to SEQ ID NO: 27099

SEQ ID NO: 27102 - DNA, 684 bp, Homo sapiens
ctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 27103 - DNA, 673 bp, Homo sapiens
gagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgagccctgggtactttccagggccagctgccctcacgctgggggtccagccatcccctgcccagttcagccgctggatccagactggggccatctgtggcgctcccccgctggagggatagtcaggagcagcagtgctgtgccaggtccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 27104 - DNA, 442 bp, Homo sapiens
ggcttggggtgcaggccagcccagactgactactggctgaaagatctgctttgggaagctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 27105 - DNA, 479 bp, Homo sapiens
tgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 27106 - DNA, 495 bp, Homo sapiens
gagcagccttcctgagagaggagagagaaagctcagggaggtctggagcaaagatactcctggaggtggggagtgaggcagggataaggaaggagagtatcctccagcaccttccagtgggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 27107 - DNA, 523 bp, Homo sapiens
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 27108 - DNA, 577 bp, Homo sapiens
aaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtca

SEQ ID NO: 27109 - DNA, 877 bp, Homo sapiens
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagca

SEQ ID NO: 27110 - DNA, 839 bp, Homo sapiens
ttgctcctagtcactgtctcactttcagattgattttaacagcttgcagttgatggtttgctcacctgcactctaccacctcatcttggagccttgcaggaacagagagggaccctgtggggattaattcaggggaaattaatccctgaattcccttgctgctctgcctctgtatttttgccagtttccctgttggcccaacccagccagaattcagagggcatgggaatatatccccgtggcccacacggacagagaaggcaggcccacagctgtctaagaggccggtggaaggattatgataaaagtgcaaattcccagaatgcccctccaggccatgcctgctgctctgagcttgaaaagagtgccaaggccattccatcccccttgtctgggttgaggtctgtattgataacatatgaaatgttttaggatgaggtatagatgagaaggcaactttcctttgcgagcccctaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtagga

SEQ ID NO: 27111 - DNA, 1279 bp, Homo sapiens
cacctagaaggaaggagagctgctcagagaggccccagggaatctgactcaacaggccctaccaggctctcctcttggtctgtgagcatccagccttacttttgtatccaatcatatttccatacttcgctgaactgtgtttatggatagtttccaccagatctttggatcttcatcttgaaggctgccgtgccacataagctatgatcaaatacatctgttatgctcttctcctattcatctgccttctgcccgttgattttcagcaaactcccagaggatgaaggggagttttctgtttggccccacaggggaggagcgagcgagattgacgtggaagctgggcctctgaaggacacagagtgctctaagaaagggacgatggggcagatccatgttcacaaacacgcccatgtgaattcactctcagatgtctcctcgtgtcagcacgctgggtgccagcacgctctgatattgacacaaagggccacggagtcaccactcactccacacacactcaccccgtgcccacttacccagggagggccaggaatgaggatgccactgtggctcagtgatggcgccgagacacaggtgaacactgtaaaatgtggatgcctggaggcagcccacaccctgggccttggctgggggaaaggttccagaaacgtcatcacaacgatgcatttcatcagaactgagcacatgaatggggaggggcaggacttcctgaatgtcccaaccccactgtcccaccctctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggatgccaatggagatgcccaggtggacttcagtgagttcatagtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatg

SEQ ID NO: 27112 - DNA, 1468 bp, Homo sapiens
cagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcattaaaaaagtaatataagtttattgtagggggaaataatcaaatgtaatctcattacccagatataatcactgttaacttcttcattcgaattttccctaggtccatgtatctatatatctatggttcataaaaatgagattacaccaaaaaatatcttttgttatctatatagttccagcttaataaatatacaactgtattattatttttgtctgaatagtattttcattgatatatcacaatatatttactccaattccctattgcatatagattatttctaatttttctattaataatactaagggagcttttaagtcaatacatctgaatcttgaataaaattcttgttccttctctttggatgggtattcagactcttaattttacaaatgaagaaataaagtcccagaaggtaacagagatagaactaggcacgattttctattcttctttccttcctttctttgtgagagttaacgattatttaaaagtattcataattttctgataataaaagtaagacatggcattatgacactggatattcaaaaaccacgatgtccttttacttgaagattttaaaaggaaatgattacaataaatacccagagtcaacaatta

SEQ ID NO: 27113 - DNA, 1017 bp, Homo sapiens
gagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggtaagtaataagctcatctaaaggcagaaatatatccaaagttatgtacttaatgttcatttataccgttcagatctatagacccagtaatgtcatttatagctataatatccagtgcatatattaataattaattgctactattgaattatgtgccccttaaaatattgactttatgtagatattctaaatctcatatgccctacttgaaacttgcctgtattattaagaggctatatgcatctttttggtttgtcaaaacgagggcattacaaaaatttagctactttcaaatgagacttgaatttggcaaatttctaagatggacattcatatccttaaattgtattttgaacttcttaccctattaaaaaaaattaactgg

SEQ ID NO: 27114 - DNA, 3583 bp, Homo sapiens
gactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggatgaatccctagaagtggaattgctgggcgcagtggctcatgcctgtaatcccagcactttgggaggctgaggcagatggatcatctgaggtcaggagttcaagaccagcctgactaacatgatgaaacctgtctctactaaaaatataaaaattagctgggcgtggtggtgggcgcctgtaatcccagctactcgggaggctgaggcaggagaatctcttgaacccaagaggcagaagttgtagtgagcgaagatcaggccattgcactccagcctgggcaacgagcaaaattccatctcaaaagaaaaaaatgttcattttctaaatatataatttcttctacagttattaactagcattcttttgtaaagattttctattactttactattactataacctcatggatttttttaaagaatcaatatgttgtaatcaattatagctactgttcttggtttttctttttgatgctcaatttgtctcaaatttgataaatgggagctccttcaagatgactcttgttcctattgacatgatcccattaatctttttttttaattgtggtaaaaaaaatacatctaacataaaattaccatcttaaccatttttaagtgcacaattcagtaatgttacatatattcacattgttgtgaaacatatctccagaacctcttcatcttgcaaatctaaaactctatacctacacaacagttccccctctctcccttcagtctctggtaaccaccattctactttctttttttttaaatatgactactttagataccttttataagtggaatcatacaatatttatctttttgtgactggcttatttcgtttagtataatgtcttcaagatttacccattgtggcatgtgacaggatttccttcctttttaaatatttttatttttattttttttctatttttctcaccactcaatttccttcctttttaaggctgaataatattccattgtatatatacacaccattttgtttaatccattcatctgtcagtagacatttgggttgcttccacttcttggctattgtgaattgtgccactatgaacatgggtctacagatatctctttaagaccctatttttaattcttctggatatatatgcagaagtgggattgctggaccatatggtaggtctgtttttaattttttgaggaacttcatactgtttttcatagcagttgcaccattttgcagtcctaccaacagtgcacaagagttctaatttttccccatccttgccagcacttatttttttgtgctttttttttttttttgaggctggagtctcgccctgtcatccaggctggagtgcagtggtacagtcttggctcactgcaacccctacctcccacattcaagtgattctcgtgcctcagcctcccaagtagctgggactacaggcgcactccaccacgtctggctaatttttgtattttagtagagatggggttttgccatgttggtcaggctggtctcgaactcctgagctcaagtgatctccccatctcggcctcccaaagtgctgggattgcaggtgtgaaccactgtgcctggcttgtgtttttgtttttgtttgtttttttttatagtagctatcctaaagggtgttaaatcagtattcattgtttttgtgtcccaactaagtattgttcactgaaaagccaagtagtatattatggcttcattttctttcttgaattgtttatttttgtagagttgttaattgcttcagtttctttcattaaattttttttttgggagagctttttcctagagccttctgttctactgctccaatttgcactgcttgttctttagccctgcaacagagctgtcatcccaggattttcctctgctgccctcctgggttgaatcctgtttcttggatcctatatcttcctctttcttatttttggttttagtagaggacatcctctgagaatatctaagaaagggtgcatagatgttttctttgtgtttacatatctgaacatgtctttattctatcctcatacttgattgatagtttgatataaaattctaaatttaaaatcaatttttgctcagaaatttgaagacatggccaggcgcagtggctcacgcctgtaatcccagcactttgggaggctgaggtgggcggatcccaaggtcaagagttcgagaccagtctggccaatatggtgaaaccccatctctactaaaaaaaaaacatacaaaaattagcctggtgtggtggcgggtgcctgtagtccagcctgggcaacaaaacaagactccatctcaaaaaaaaaaaaaaaaaaaaa

SEQ ID NO: 27115 - DNA, 4318 bp, Homo sapiens
actgctggtttgccctccccctggtgttggcccggctgactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctcttttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtactgggtagaatctggagttttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtga

SEQ ID NO: 27116 - DNA, 3320 bp, Homo sapiens
gatgagacgggaaaaggtggagccagtgggcacggtgggcggtgcggagggcggggctgaggcgcctgagcggggcacaaccctcctagaggcgggacggtttcctgccaatcactgctggtttgccctccccctggtgttggcccggctgactcggggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctcttttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtc

SEQ ID NO: 27117 - DNA, 1483 bp, Homo sapiens
ctggtgttggcccggctgactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaagatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggatgaatccctagaagtggaattgctgggcgcagtggctcatgcctgtaatcccagcactttgggaggctgaggcagatggatcatctgaggtcaggagttcaagaccagcctgactaacatgatgaaacctgtctctactaaaaatataaaaattagctgggcgtggtggtgggcgcctgtaatcccagctactcgggaggctgaggcaggagaatctcttgaaccc

SEQ ID NO: 27118 - DNA, 706 bp, Homo sapiens
gggagggacgagggggtcggcgttacccggcttggagggggatgggggcgcctgttgcttctccagggggttgcgcacgccgtccgccccttggagggattgggaggcccacgccctgctgcgagaagggcgcgttctagctcctgaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaa

SEQ ID NO: 27119 - DNA, 573 bp, Homo sapiens
gcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacagtatggaagacagttatttaccttcttgtgttctcgaattttgttttatttcaaaaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagta

SEQ ID NO: 27120 - DNA, 429 bp, Homo sapiens
tgctggtttgccctccccctggtgttggcccggctgactcggggtaggggaggtcggggagggggcgataaaatggcgcagggggcggagtgaggcgcagtcgttcgcccaggctttggcccggcttccggagtgtgccacatttatgttcacgatctcatttaattcttgccacaaccctatcaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgt

SEQ ID NO: 27121 - DNA, 551 bp, Homo sapiens
cttagacattgcctagcaccccttttccatccctttcccattttgtaaatgaggaaacaagtctaaatggtcaagtggcatacccaagttattggagctggctagtgatacaaccaggactacaccccaggtctttggactcccatgccagtattcatcctactaaagtagatgatagtcttaagaaagtacaaattgttgggaggaacaaaactagtttgcttagttgcataatttttttttctttgaagatttctttggtgtgcttgactcagaaaatccaactttctggtattacaaaaaaaatcaagattaaaattaatacatcgagcaccttaaagcataatacagttgactttgtaattagcagagttgaaagtgatgagaagatcctctaattttctttttgcctgcaggaaggtgggagtcaatcattttgacaagtctcctgaaaggaacagctagcaggaactgaaacctttttccatttggtctcgtggcaaaggcagagattgctccagcagctccacacaaaatgatgtgctcacggg

SEQ ID NO: 27122 - DNA, 725 bp, Homo sapiens
ctctctttccctttaaagctcccagtatagcatcttccagtacttacttgaaccgtaatgggtcatttttaacgtctgatccccttcagacaagctctggcaggcccttgacgtatccccagcgactaagcaccacgtctggcacttaataggggggtggaatgggagtcctggattcaaagtttggctccaacacaagacaactggacgcaagaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatact

SEQ ID NO: 27123 - DNA, 1688 bp, Homo sapiens
ctggtgttggcccggctgactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaagatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggatgaatccctagaagtggaattgctggacagggtttcaccaagttggccaggctgttctcgagctcttgacttcaagtgatcagccctcctcagcctcccaaagtgctgagattacgggtgtgagcccccgcgcctgactgagaattaacattttaatattgagtgttttgattaaagtcttctctaatttccttcataaatgttttgtagcttttgtacagtcttgcacatcttttatccaatttatcccggagtgtttcatattgtgatgcttttgtaaaatgatttagtttttaaaatttcagtatctgttcattgctattatatagaaatgtaattgatttttgtgtcttggtcttacattctataaccttcctaaattcttttattagttttagtaactttttaatagatttcatcaggttttccct

SEQ ID NO: 27124 - DNA, 551 bp, Homo sapiens
agtcgttcgcccaggctttggcccggcttccggagaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactg

SEQ ID NO: 27125 - DNA, 3708 bp, Homo sapiens
ggcatctctcgcgtgctcttgcttgcgcactaatttgtcctccaccgcctcccgttcaggccggctctcctgcggggcggggaaaggggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttcta

SEQ ID NO: 27126 - DNA, 1909 bp, Homo sapiens
gtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctga

SEQ ID NO: 27127 - DNA, 3908 bp, Homo sapiens
ccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 27128 - DNA, 4022 bp, Homo sapiens
cacacgcgcgccgcccggccccactcgcgcagcgcgggcctccgccggccgcattgtccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtggaagacagtgaaggaagaggctcgaaagtgacagagactgagccagtgtcctcgttccccgcaggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaa

SEQ ID NO: 27129 - DNA, 4055 bp, Homo sapiens
ggacttcccgggcagcctcccgggaggaggagggcaaaggccgactgccccaacccggccccgggcagcgcctacgggttttgtgccagacaggccgtttccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctgtggga

SEQ ID NO: 27130 - DNA, 2725 bp, Homo sapiens
actcttgtttcgctccttgacaaccctggcgggggttcgctggctgcggccccggctccggcccccgcaggagcagctgcccctagggggagacagactcgcctgctgtgcctgggtcggaaggattcccgctgctcatcctcatcctggatacaggtggcaggcgccaagccaggattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccag

SEQ ID NO: 27131 - DNA, 2486 bp, Homo sapiens
gttttggagaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggct

SEQ ID NO: 27132 - DNA, 545 bp, Homo sapiens
atttagttcttcccagcggcagcttgggtatggtataaacatgttgccttgtttctgccctgggcaaaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactgggaccccacttttcagaagctcttggaggcccagaagagcccctggttcttccctgcacaggtgaggacctgcgggtgcggaggaggaga

SEQ ID NO: 27133 - DNA, 538 bp, Homo sapiens
gttttggagaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccag

SEQ ID NO: 27134 - DNA, 444 bp, Homo sapiens
ggatccagcctccacccgggtccgcggcccgcgccctgactcacctcctggcccccgccccgcctgccgcgccactgattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctca

SEQ ID NO: 27135 - DNA, 1012 bp, Homo sapiens
ccacacgcgcgccgcccggccccactcgcgcagcgcgggcctccgccggccgcattgtccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttc

SEQ ID NO: 27136 - DNA, 546 bp, Homo sapiens
tccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggt

SEQ ID NO: 27137 - DNA, 621 bp, Homo sapiens
gtagatttcagctcccagaggctcacttcttgttttggagaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggtaggcgatg

SEQ ID NO: 27138 - DNA, 1004 bp, Homo sapiens
gattcgcagtagtagatttcagctcccagaggctcacttcttgttttggagaatggggcctcgacctttttcatcttgtgaaacccagactcaatggtaaactgttttgtgatgccaggatgccgcaggaaagactgagaggcatctctgggagttctgggagggcggaggcgggtgctgacagttttcagcactccccgctcaacctccatcagaatatttagttcttcccagcggcagcttgggtatggtataaacatgttgccttgtttctgccctgggcaaaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccagg

SEQ ID NO: 27139 - DNA, 1254 bp, Homo sapiens
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctataggggccagcattgactttgagcacacgtcagtcacctataaccatgagaaggcccactcctactggaactggatccagctgtggaactacgcacagcccccagacgtgatccttgagcccaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaga

SEQ ID NO: 27140 - DNA, 513 bp, Homo sapiens
atcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgtta

SEQ ID NO: 27141 - DNA, 1153 bp, Homo sapiens
cagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgacctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctataggggccagcattgactttgagcacacgtcagtcacctataaccatgagaaggcccactcctactggaactggatccagctgtggaactacgcacagcccccagacgtgatccttgagcccaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaga

SEQ ID NO: 27142 - DNA, 528 bp, Homo sapiens
ggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgtta

SEQ ID NO: 27143 - DNA, 445 bp, Homo sapiens
gcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagatgggagccccaggttat

SEQ ID NO: 27144 - DNA, 5130 bp, Homo sapiens
gctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 27145 - DNA, 5253 bp, Homo sapiens
ctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 27146 - DNA, 4334 bp, Homo sapiens
attctgccccagctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaaccggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacact

SEQ ID NO: 27147 - DNA, 565 bp, Homo sapiens
atgtcgcggaggaagcaagcgaagcctcaacatttccaatccgaccccgaagtggcctcgctcccccggcgagatggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgac

SEQ ID NO: 27148 - DNA, 4925 bp, Homo sapiens
gcttttacaatgggagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtctccagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 27149 - DNA, 2665 bp, Homo sapiens
agagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtctccagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgccagaagaagttcaccaatgctgtcactctgcagcagcatgtccggatgcacctggggggccagatccccaacggtggtactgcactccctgaaggtggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctccc

SEQ ID NO: 27150 - DNA, 3762 bp, Homo sapiens
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcc

SEQ ID NO: 27151 - DNA, 3903 bp, Homo sapiens
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtaagtgtcccagcactgtgtgtggtgtctgtggcaagccttttgcttgcaagagcgcgttggaaatccactaccgcagccatactaaggagcggccattcgtctgcgcgctctgcaggcgagggtgctccactatgggtaatttaaaacagcacttactgacacacagattgaaagagctgccttctcagttatttgaccccaactttgctctaggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactag

SEQ ID NO: 27152 - DNA, 2958 bp, Homo sapiens
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgccccccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcc

SEQ ID NO: 27153 - DNA, 3452 bp, Homo sapiens
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaa

SEQ ID NO: 27154 - DNA, 831 bp, Homo sapiens
atgtcgaggcgcaagcaggcgaaaccccagcacatcaactcggaggaggaccagggcgagcagcagccgcagcagcagaccccggagtttgcagatgcggccccagcggcgcccgcggcgggggagctgggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaa

SEQ ID NO: 27155 - DNA, 1918 bp, Homo sapiens
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaa

SEQ ID NO: 27156 - DNA, 9678 bp, Homo sapiens
gacgtcggcgcacgtcagcggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtgttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacaaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctcctaggaaagaaaaagtcagtggccctttcttcctcagatatcaagaactcccaagtgtttaaaccgtatgctggagtcagtggttgggacagacaggagcccaagactgaagccagcccttgcctcttgtgtcccttcccaactctggtgctggagtaatggggtgctctgcattttgatggggagcaaggggggaccccccctgtaggagtatcggcctctcccctgccccctaccctctctcgtggaccaaagtctccagcagaagagactcatcataagactgacgactcccccacctccacccacacaccgagtgtcatcagtcctaaaggcagggaaacgctcacagaattctgcccacgggttagatgtggggagaaggatattctcagctccagagtgattaggtgatcagccagaaactaaggcaaggtgacaagcagcagcctggagtcacagttggtcccaggcgtgtgggcactaagcagcctctggagacatgcgggcagttgaggatgcaaggacacagtgagtgagtggcgctcctttttggggtcctccagcctctagtcaagccccaggttcgtaaatatgtttgtattacattttaaaacctgtatcaacagtcacatttaagctccctattggtttaaagaaaattcatactccaggtaactttttcccattcgacctcctatagagacaatatgcagtgtgtcatttcacagtctcagtccctgtgaacagtggctgacaccggtgccagggctgacctgctacactcaaactcctaaactgggctgcctctaactgcctcctgggaagccacccgagccactcggtctctttgtgcctaaacatgaaaggtgaaaattggagaacagggaagctcgtaagttggagtcattgtacaggcagggatctttgatcattttgttgcttctggaatttatttaattttttttttttttgagacagagtctcgctctgtcacccaggctggaatgcagtggcgtgatttcagctcactgcaacctccacctcctgggttcaagccattctcctgcctcagcctcccaagtagctgggactacaggtgtgtgctaccgcatccagctagtttgtatatttttagtagagatggggtttcaccatgttgtccaggctgatcttgaactcctgacctcaggtgacccacccaccttggcctcccaaagtactgggattacaggtgtgagccaccacacccgacctggaatttttttatagaacttatcttcagagcaatgtatgaaagacaagagcagtatcagccgggcgcggtggctcacgcctgtaatcccaacactttgggaggccaaggcaggcggatcacgaggtcaggagattgagaccatcctaacacagtgaaacgccgtctctactaaaaatacaaaaaattagccgggcgtggtggtgggcgcctgtagttccagctactcgggaggctgaggcaggagaatggcgtgaacccgggaggtggagcttgcagtgagccaagatcgtgccactgcactccagcctgggcgacagagcaagactccacctcaaaaaaaaaaaaaaagacaagagcagtatcatctgcctctgtttctaaactggacaaagagattttcttaaagtttctatcatctcccttctgacaggttctacagtgtggtctgaagcacctgtaatgtcagagcccttgtctggcccttggtggcaggtgaacgaaagcagtggagcctctcaccttccagtagcctctcacattcttattttaccatttttgtcctaattaaggtagcctagctgattctagaagacagccatcctacgtgcacccccaccttgtgtccacatcttctccaggcaggtttcaacctatcagcagactcaggcacacactggggcacagatagagaaccaggcggcagcagtgctcgcagacccacccagggagagctgtgatgggttctgcccagatactctgctcgcccacccacaagggagcaatagcttatatttgtacattagttttaccaagcactttctcttctaaccctcacaacaattctatgaaattagctggggagatactgtccttatttttcacagctgaagaaaccaaagctttgggaagtttgtgacttctctgagatcacagctggtgatagaaggagctgggacacgcgcttgggttgactggcttctggttttggttctctggcttctagtgctggaagaagccctctctttcccttctctttcctcagtagcatctgactcttttcataagcaaacagctgtataaacaaagcccccattttggtcaagcacagggtgaatgtgatattgttcccacaaccttattctccactcaacagccgcctggctttggggaagaggccgccttcaggtgacagtgcagctgtccaggtggccgtgcactgaaccaggctgagggagacaaaaaccccgcagacccgcctgcctttcagcgtccagttaactgcagaagtttaggctcacctcaaagatgtctagtttttccaagttacaatacagcagtttcctacagaacacccccttcctcaattgccaaggggccgcatcgcacggcatcaggccaccactgcaggccagcagattccaccccaggaacggtcatgaactcagcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaactgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 27157 - DNA, 4784 bp, Homo sapiens
attgcgcctgcgcagggagcccaaggcaagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggcctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcccagggcacacctcattcccagttctatagcaattcaccaagaacaaagtctgcagttagagccaaagctggtggtggccagagggtgctgaagatacaggccagtggggatgggagccatgagccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataagagaatagttaaaacacttctcctctcatgcctaccatggtgctgtatcaaggggatttgttcacatatgggctcagcaacgcacaagtgaggtcagccatggcactaggtcattcccattttagccaaggtgcctctataggggtcagacatcatgtgcccagacctaaggtcaggaatgtcatatttttctgttaaaatcattttatttctgtgtatcttacctttaaatcattgtggtttactctgagattctgtagtcctaatattgtatcattgtgctgtctgcaaaacaacttgaatctattttgtttgcatcttttgttacatgtaacgcagctgtactttatgttctttgcaactgtttccattatgagaacgctgtgctatttacaaggttacatttttcttggccaggcgaggtggtcatgcctgtaatcccagcactttgggaggccaaggtgggcggatcacttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaagaaagaaagaaagaaagaaagagaaagaaatatctttgctatttgtataaaaatggaaattttaacagcttagcctctagagagttactgaacgtggttaccttgggaatgtaaatagaactgcaaattaaaatgactggccacttcaactgggtaagggaaacagctgcaataaagcttcgtgaatata

SEQ ID NO: 27158 - DNA, 1395 bp, Homo sapiens
agtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggaagaagtaaaatatactcaaatccaatatacttgatctgtctggtagtgatacctaaataaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgtaagaaacttgattgtcatttccctataaaattttccttgatacttggctagagtatcatactaggctcaactagacatttctagatgagttcaagtgaatattaagtgatt

SEQ ID NO: 27159 - DNA, 2185 bp, Homo sapiens
ggaagctcagcagtgtccactgtcgccattccttggccatagaaaacaatgtatttgaattttgatgtaagcataacaaattgaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaataactgcaacttggaagataaattagcttggtatgaaggtgaagcttacatgtggcatcactggaagccttttcctgaaaaccctctctggacatgtcttgatttccaaatagcacaagttggaccctgggaccactgctcctcttgtattcgccacacacgtctcaagtcttcctgctcagatatggatctcctacattcatggcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 27160 - DNA, 1382 bp, Homo sapiens
tagacagcacactgctgactgttttcagttgtttctgtaacagcagaaagtgcactcactaggagtagtcagaattcaaaatgctcaagagaaagccatccaatgtttcagagaaggagaaacatcaaaaaccaaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 27161 - DNA, 1888 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 27162 - DNA, 1895 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 27163 - DNA, 1677 bp, Homo sapiens
aactcttcatctcgcggctgtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatt

SEQ ID NO: 27164 - DNA, 1749 bp, Homo sapiens
gtcagctgggtgactcatacatctgtgagaccctccgtatggagaccggggcggggggtgttgcttaatgcttagaactgctgaaactaccagttcactgtctcagcactaatccaactctgctccttaagtgggatttggcttttagacattgagacctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggaatgactgggagacagaaagcaagtgaagtcgccactgaggtcccattccgcctcatgcaccctcagcctgaggacccaggtcagtttagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgg

SEQ ID NO: 27165 - DNA, 1591 bp, Homo sapiens
ctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccagctaaggaaagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgg

SEQ ID NO: 27166 - DNA, 791 bp, Homo sapiens
gagacctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatcccc

SEQ ID NO: 27167 - DNA, 1521 bp, Homo sapiens
atgtgccactggaatacgtcagctatggggccatcagcattgagggggcatggctgaaatggggccccaaacggccccctctgtcctctccaccttcctcctgggtgccctgctcctctctggaccaggaggcatctggtttgagccccgaaagcccaagtccttgaccagagaagggcgcctgttctcagggaaagccactgcacaggacagctgtcaaaccacgtggtctctgggcaccttcttagtcctgagcttgaatgaggggcgagtgagtggccactgtttcttctgagtcagcagcgaagggcagttacctttggggcttgcaggcaaaattctcaaccaacagctaccacgcacttggcggggccgcctctcgtgctttatatttgagaaatatgtgcttcgtgtcttttttagaaggtgtagtgaacttcatacaattcttctggtctactgggcgcacacttcagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccaggtaaatgaagcagcaaaaataatataggtgaaatctcagaaattctgaagaaacattctctgcatcgaggcagcttagttgacgggaaagaaaaacagatctgtctaaatgagaactctccgta

SEQ ID NO: 27168 - DNA, 2576 bp, Homo sapiens
agaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgagtggtgcacaagtgaccatctacctggggaacagagactacatagaccatgtcagccaagtccagcctgtggatggtgtcgtgttggttgatcctgatcttgtgaagggaaagaaagtttcctgactacttgccctgttcagtgatgttgcagccagctccacaagattcagggaagtcctgtggggttgactttgaggtcaaagcattcgccacagacagcaccgatgccgaagaggacaaaatccccaagaagtaagagtatggttgcggaataggtgaggggtctgcggtgggggtggagagaagagacgacctccaccttgtctctgtgggacagacctcttcccatagggctggcacggctggggtaccatctgcatgtgggatggaggtcaaaggttgatcatttttggggaaaaaaaagaaaacaagaaaatgacagggaagttagcaacctccagggctcacgtaagccccgaaaagctcccgggtttcccctttgttgaagttttgttgttgttgtttgtttgtttgtttgtttgttttttgtggtaaaatgtacacaacatgaagtttgccattttaaccacttttttttctttttttcttttattttttgaaatggagcctcgctctgtcccccaggctggagtgcaatgtgacctcggctcactgcaacctccgcctcccaggttcaagcgattctcctgcctcaatctcccgagtagctgggattacaggcgtgcgccaccacgcctggctaatttttttttttttgtatttttagtagagatgggtttcaccatgttggccaggctggtcttgaactcctgacctcaagtgatccgcccgccttggcctcccaaagtgctgggattacaggcgtgagccactgtgcccggcccattttaaccacttttaaatgtaccattcagtggcttaagtacattccgaatgttgtgtagccttcaccgctgtctatacccaaaactttcccattgcctgagcaggaactctacaaccattgagcctaccgctccatccttcccattctcccaccccctgtgctgttttttttttacctaaacaagatttccgcctggcccttcgcactgtctccttgtgccccatgtacacatctctggaggcgcaggatagtgagctgcagtaatggagctcgcatgtatatggcagctattccatgaggcccttgacgccctcacaccttagccttgctgacaggaggcagagctgggaatccacggagcctaaggggctaagcttggccctcgggatgttgcctggccccacagcttcccccacagggaagggaccaggacccagacccccaggctcttccaccgtcagggctgcctcaggctctgaccagtgtcgttgccctcttcccgtccaccctgtctccatggggagcattcctggagaatctccatgtgacagtggggagagaacagaagcctccctaaagcggcctgggtgccaatccctggcttgtctgtggctgtttcccacaggagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccaggtcagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgg

SEQ ID NO: 27169 - DNA, 926 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaag

SEQ ID NO: 27170 - DNA, 995 bp, Homo sapiens
agtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacact

SEQ ID NO: 27171 - DNA, 1163 bp, Homo sapiens
ctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctc

SEQ ID NO: 27172 - DNA, 1125 bp, Homo sapiens
gtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattctt

SEQ ID NO: 27173 - DNA, 2519 bp, Homo sapiens
gaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgcca

SEQ ID NO: 27174 - DNA, 1011 bp, Homo sapiens
cgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggaca

SEQ ID NO: 27175 - DNA, 2722 bp, Homo sapiens
cacaaccccaactcagagaagccaaagcgctgggaattcagctttaggcagaacccacgcaatcttatatccgtcgcgcagtgatgacgtagcgcgagcgctggcatgagggcggagccaggcgcaggaaactgccgttttgattggtttccagtgtggcgcgggggtctcctgggatccgaaagaacctgcctttccgcccggaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgcca

SEQ ID NO: 27176 - DNA, 437 bp, Homo sapiens
atgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgc

SEQ ID NO: 27177 - DNA, 3227 bp, Homo sapiens
cctgttactttcacttggagaatagggaggcttggggtgggggcaggactgtggaggaagtcaagtttgctgtcttctatggttgtggtttgtggcacaacaaaacaattatactagtaataccaaagatcactgatcatagatcatgatgacagatataagaataatgaaaaagtttgaaatattgtgtgagaattaccaaaatgtaacatagagacatgaagggagcacatgctgttagaagatggtactgatacacttactcaactcagggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 27178 - DNA, 3185 bp, Homo sapiens
acatccggcgagtagctggcggtcccgggtgctgctggttagtgtgctctgagggagggtccgagccagccgctgttttgccggaggagcccctcaggccgttcaagcgtttctcctgcctcagccttctgcatagctgggattacaagcaagcgctgccgcgcccagctgttcattttattcttcatctggcattctttgaatagatgcaggtctctctatgttacccaggctggtcttgaactcctgaggtcagggaggaatcccccacctcagccttgcaaaatgctgggattacaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 27179 - DNA, 2996 bp, Homo sapiens
gggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 27180 - DNA, 3066 bp, Homo sapiens
gggtgtgacgtacatccggcgagtagctggcggtcccgggtgctgctggttagtgtgctctgagggagggtccgagccagccgctgttttgccggaggagcccctcaggccggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 27181 - DNA, 783 bp, Homo sapiens
ctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgatatattgcagctcacttctcacactggcccctaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcct

SEQ ID NO: 27182 - DNA, 2810 bp, Homo sapiens
atgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcatttt

SEQ ID NO: 27183 - DNA, 672 bp, Homo sapiens
gtctttctggtggactgtgcagatcattctcgcctcgtggaatccaaagttgagcttaatgatatattgcagctcacttctcacactggcccctaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaa

SEQ ID NO: 27184 - DNA, 1082 bp, Homo sapiens
agtgtgctctgagggagggtccgagccagccgctgttttgccggaggagcccctcaggccgtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctg

SEQ ID NO: 27185 - DNA, 2314 bp, Homo sapiens
gaggtcactctctctatctatgtcgcctcaagcagcagtggcacgcaaaggtcagtcagccctggccaggctgcgccctccccccggacagcactcaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggaaaaacaacattgctacacatgctaaaagatgacagacttggacaacatgtcccaacattacatcccaatggagtctcgctctgtcacccaggctggagtgcagtggcacgatctcgactcactgcaacctccgcctcccaagttcacaccattctcctgcctcagcttcccgagtagctggaactacagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcaaaaaaaaaaaaaaaaaaaaaaaaaaaa

SEQ ID NO: 27186 - DNA, 6682 bp, Homo sapiens
gagaccaggcggctgggagacccaggcggtgttaggggttgcgagcagcctcgctcaactggggaattggcggcaagactgccaggaggcggaacctagggcgctcggcgacgcggtcctgcggactgtcgctagtgaggcacccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgagatatgtggagattttgttcctatcctatagctcttttgtattctttggcatattttatatcctggtagaagaaaacaagtgcttgtttccaattttcttttttcttatttgctctcaggtagttcttactccatacaacaaagactttttgtttgttgggctttttttttttttttttttttgctctgtttcattttgttttagagacggggtttcaccatgttgtccaggctggtctcaaactcctgacctcaagtgatctgcccgccttggcctcccaaagttctgggattataggcgtgagctaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaatatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcccaggctagagtgcagtggcacaatctctgcttactgcaacctccacctccggggttcaagtgattctcctgcctcagcctcctgagtagctgggactacaggcgcgcaccaccatgcccggctaatttttgtatttttagtagagatggggtttcactatgttggccaggctggtctcgaactcctgacctcgtgatctgcccacctcagcctcccaaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaactcta

SEQ ID NO: 27187 - DNA, 929 bp, Homo sapiens
gtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaa

SEQ ID NO: 27188 - DNA, 548 bp, Homo sapiens
gatgcgaactggggccacggcagccatcgcgctttgcagttcggtctcctggtgtacggccaacgccaagtaggggattgcgttccctccagtcgcagacagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgca

SEQ ID NO: 27189 - DNA, 708 bp, Homo sapiens
tgctgagaaaggtaaaaacaccttcaaataaggaagaggaacaggctatgacctaatgcttgcttggaccagtgtaacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaa

SEQ ID NO: 27190 - DNA, 670 bp, Homo sapiens
cggccaacgccaagtaggggattgcgttccctccagtcgcaggcttttcaccattctttagctctcacctaccaacaatcatcttcagtgaggactttgccacttgattcacagtctgtatcagtgccctccagtcttccagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcc

SEQ ID NO: 27191 - DNA, 2287 bp, Homo sapiens
gaggtcactctctctatctatgtcgcctcaagcagcagtggcacgcaaaggtcagtcagccctggccaggctgcgccctccccccggacagcactcaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggaaaaacaacattgctacacatgctaaaagatgacagacttggacaacatgtcccaacattacatcccaatggagtctcgctctgtcacccaggctggagtgcagtggcacgatctcgactcactgcaacctccgcctcccaagttcacaccattctcctgcctcagcttcccgagtagctggaactacagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggca

SEQ ID NO: 27192 - DNA, 455 bp, Homo sapiens
ggaaggaggaagtaacttgtggaatgctgagaaagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaac

SEQ ID NO: 27193 - DNA, 5581 bp, Homo sapiens
cagtcaccatgagggcgctggtcctgctcggctgcctcctggcctcgctcctgttctcaggacaagcagaactgcaagtctccgcgtcgggtggcacagaagatgttggcaatttgttggagaatcatttctctgctggagacgcaagtctagaggagaaagaaagggcgctttatgcagacacagcccctcaagacaagaaactgctccttcactacccagatggcagggaggccgagagccccaagaagacccccgcgtctgccgccagcgcgggccccgatcctgaagccagcctctccaatgcctcagccacagagtcacctccacctggggaaagggacgacagggacgctgcggggcctggggaggaaaagaatggcccaccagtggcaagcgccctccctccaggaggggccaaggggcctgtggaagaggagtggccggagcccagttctggagagggacaaggagaggaggagactgggtttgggctccccacggagggaactgccagtggagaggcaggaggacaggctgggggccatgaactccccgaggaagtccaggaggtccaaggggacagcctggtgcagggagcagtagcagggacagcagagccaaaggcagagggggcctctcctcactcagagggtgatggggtcggcccactgaacgcagaggccgagggcagccctgggcctggcgaggagcctgcagtgccagagggagcccctgacgtcgcggctgttgggggagagtcggagccagatattgacacacaagccagtgagggcaccgaggaccagggggagcccggcccagctgcagaggccagtgcagagcctgggggcgcccaaagcgttaaggcaggggacactgaggagaaccagtccccagagatgactgaggaggacgcagatgaagcctcctctgaagaggaaagtggtgatggaagtggaagcgaggaagaaggaggagttccctccgaagaggagtccgaagaggacagcggcgatggggctagctcagaagaagcagagggcgcctccgaggaggccacggagccccaggaggctggggagccccaggaagccagggagccccaggaaggcggggatctgcaggaagccgaggagtcccaggaaggcggggatccccaggaagccgaggagccccaggaaggtggagcgccacaggaaggcggggagccccaggaaggtggggatccccaggaagccagggagccccaggaagccagggaaccccaggaaggtgcagagcttccggaagccacaggaaccacaagtcacagggacagaggggcccagcctggcccggaggaattgaatacagagtccatgggcagtgagaccctggatatgaaggcagaggagcccgaggagggacatcagagggagagtcccatcattgttgcccaggaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctcttt

SEQ ID NO: 27194 - DNA, 4212 bp, Homo sapiens
cttggcagtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctcttt

SEQ ID NO: 27195 - DNA, 1814 bp, Homo sapiens
agacagcgcgtcagtgacaggcacacccgggccagggtcctctcctttcctcagcccgtctctctgtgacagaccctgcctgcactcccaagcccctctctccctgtacgaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctg

SEQ ID NO: 27196 - DNA, 1432 bp, Homo sapiens
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctc

SEQ ID NO: 27197 - DNA, 1057 bp, Homo sapiens
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 27198 - DNA, 1349 bp, Homo sapiens
gtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacccctgaagttctacctttcccccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgaccaacagagcagggactcattcagggtccacagccagcgactggtaattgacaacattcttgagcacttgctatgtgcttggcactgtcccatcaacatattttatgctcaccaccactccaggagacaggtgctactattatccttctgacattacaggtgatgaaacagaggcacataatcatcctagctaagcacttgtctgagtctggattc

SEQ ID NO: 27199 - DNA, 1060 bp, Homo sapiens
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagtcttgctacgacaccttggcaccccactcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctc

SEQ ID NO: 27200 - DNA, 4431 bp, Homo sapiens
atacaacgcgccccaggccaaggtcctaggtgcaggggccgccgcagagcctgagcccgcagggctgggatgcgggtcgtcagggatgcgggctggggaggggagggtgtgagcagcgggtgcccccagtccccgccagggcgcaagcgcaggcgcgcagggtgcggtcgcggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagttcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattg

SEQ ID NO: 27201 - DNA, 2645 bp, Homo sapiens
atggcggcagcggcggcggcggctgcagaacagataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatg

SEQ ID NO: 27202 - DNA, 1606 bp, Homo sapiens
agagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaa

SEQ ID NO: 27203 - DNA, 9455 bp, Homo sapiens
gagcagaagaaagagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagaccattcagaatcacacagcgtattaaacactgacagaatcttcatctagatattcgagtagcagcatatcttctcttttagtgtcattacgagggagtgatggcgggaatctcagtcgcactcaagctctgagacctttgtatcaaaaataggcatttgatttcctgttttagctttagtaaggctggctaacttccccctcttcaagctaggaactggcaatgctgtagaagtcagccgtaggaattcaaaatggctggcctaccttggctaccagacatattggggtttttgtagttgaatgaatgaggaggatgaatttcagcaaattttgaactgctcacccaacttctgctatcttgctccctccaaactcacagattctcctacagtcaaattaggagctgtaaatcagcacaaaataagataacagctgttcctcagtgagctggaagctacttaatggcctgatgggcaatgaacaaacgggtgatatgtctctgtttaagggaaaaatggcttaaaagctgttctgttctcacttctgactttaaccaaaagatttcaacccacaatgatcaggtcaatcaaaatccctaagagcagaactcctaccccaaaagaagcctggaagtctaattaagagtagcataaggaacctaattatgtttaccatgtttcttgggattggtgggaaatgtcaaaacatgccctttatttttaaaggcattcacaaactctctgactttgttcttcttatatattttttcagtgccgggatattcatattcctaaagccactattgtgttttctctaagaagcactacatgccaccagaattgtgcactgaaagataatacaaactgagtgtctttatgagaatcactgtgtcccctgaggcccagcagtacctgcttccctgtatgtggaagcagcacctcattcccgccatcagctacctctcatcaccccaccttcatcatcatgctccagggtcaccctggccagctcttgtgctgggacaggggattacaccatctctgttcaaagagggggaaatgtgcctatgccttaagtcaatgcactcagcaaggagaagcacatcttatttatcttgttacctatagtttactttgggtgattggaggggaatgacttagttatgactggacatcttaaaagctgatagacaagccaaatggctggcagatgatgtggatttcaaagagcccagaatgaactcatcactggcttagacagtcctggatgccatttggaaagtagtggccctgcaagcctaaatgaagtagtatttgtaggcctgggtggcatttggatttttcttttccctcaacaaggttttactttttcttactttacaagcaagggaagttttgtgataggagagaaataaaagatttgatattttttgagatgacactcaagcatcaggctgagatttgcacacatgggatgtaaaagcaagctgtgtgttgcttagtcacttacttagaagtagatggtgggggacagcggcgtgggtcctagcctggccagtgatgctgctggcgtccagaccccagactcactccaagcactcttgttcaatatctcatgcagaagagttgggctggtcactcttaggggtgagaccccgtgattggttggtttgtagcactaaggtctaaaaaggaaaaccataaaagacatcagattacgctggatcagtataattaatattccatagggccatgttgccagaatctgtatgtatcaatacagggtttttccaagccaggaaacgccctccttggctactaggagcacctatcccatatcattcagataaacaatgatagctacaaagtcatttgtggctagataggttaagacaggtgattttttaaagtagactgtctttgcattttgccatctgaagttcattaatctttagatgacaaaaaagcaaaaagttcccagaacgtttttgcttagattttgttctaatcaccacgtgaaggaatgagattagcaccacaagtttcatgccaataaaagagactggtgtgatcccacatgcaaaatttaatcctaagggtagtgagatcacaaacagaataaaaataagagcaatcaaccatataaatcaagtacctattgggaacagacataacattcaatttttcatttatgctaagtgaccacagtatacaaagtaataagcaggaaatttgatatgggttaaattatgcattttgttcagattttggaaattggtatgcattataagtttctcaatgtacatctttttatcccaacaccctcaaactagaatatttgtcagtggtcaagagaaaaaattttacctgaattcttgggggccggcggggagcttttacattaaaaatctactaacgcctactttttaaaaaatgagattctttctaatctttatatatgacattttctagacaatcgcacctttgggtatattaaacagctggtatcataacaaagaatccaaatgaaccttcaatatactagaagttctagtaggttaatattgttcagaagatttttacaaattaaaaactgatttccaaatatgttcaacatttacttctatttgatatctgctcaagaagtcatagaagtcttgggaaactattcgagtatcacagaggttttcaaaagcccttatggtgacatctacctaggtaaaagcctgacatgtggctttataattgttatgttacccaagggataaacttgaactggctttgaacatcctttaggtcattttctctttggataattttcatcgcatatccagcaactatagaccaaagtttgcttaaggtttgaccctagagcagaggtgggcaaactatgacctggaaaccaaatctgacttaccaccttttcctgtagttaaagttttattgtcacatagccacatacattcatttacatgttttctgattttacactacagcagcaggatggagtagttgtgtcagagactatgtatcccacaaagcatagattacttactatttagtcctttacaggcaaagtttcctcacccctgacctagaggtttttgtggtatgcattggatatagcaggaaagaaagcacatttccaaacagcagggagtaagcttacatttctgtgtaggtttgggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttagttcccatattcatctaattcatggggttctaacattttggggggccatagattcttttgacaatctgagccaatctatgaaacttctccccaaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagcttaaaaaaaaaaaaaaaagaccggaaaatacctgggttgttagcctcacatttaggaaaaaattgtaatactcagttatctgtgtgtgtggctaaacaagtcagcatttctgcacacatacatctctttcctttatacttcccttcaaaagacaaatatcttacttttgatctttgacactatttggtcagtattcttctttacctttacttgtggcaaaactcaaggaagcgatcaaatagagggaagctcatttctatcattgtctctgtttccctataagaaagaactaccagggactcactgactgcattaggcatacaatgtcagagctgagctgaccactctggtcctgtaatgtctttggcctcacaccttggcagccatcattaatgggccatacccttccccaggtgcagaattctcctccccagagcactcaggccgttactaccaatttatctgagttggaaataagactcatttgccagttcttatttttaaagtggcaccctttaactttgaacctgtgtattttacactggcatcctagattcagcaatgaggtttggtggtgtttcaactaggaagggagaaaatgagtgcatctgaagttccttacagcttggtttctttggaatgctttcatcttctaagcaaagggatcagggtttgatctgtaagagttaaaaagacaaagtcattttgaagaattaactcagccagggatcatgcaaaaagattagaaaccataatgcccttgttaaagccctgctgtcaacctgccttcacccagagcttagagggccacagcagcaaagaggttggggtccatccctctctgatgtgctttttccacaacacatatctggtcctctggcaggattgtggatagagctcctcaccatacccaaaagactcagccccagtgccagtgctttcctggttcaacaacccaccacaaaaccttagtaaaaggatgagccaaaaatgaaaaagactcgactctacagtaagtcagtcagggatttcctttttaatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaaggaggtcgtgttttagaaggaaaaggcagaggctatccatcattatgctggctagatgcgcttctgaagaagccggattctgatgttcttaaccaaaatggtgaggtcatggaagtcccatttgcttggagattttgaaaa

SEQ ID NO: 27204 - DNA, 1571 bp, Homo sapiens
agagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaagatg

SEQ ID NO: 27205 - DNA, 1412 bp, Homo sapiens
gtgatatctattgaagctgggagggtcacagtatcagtgagtggtcccccaatttcttcttgagcatcgatgaattagcagtggtgtaatattgtggatctgacttcatgtgtcactaagaacaggagatccaagactgctcttctggggatgagacttggaagaaacctccatcctcagggatttgaagaaggttatactggaacctgtgtgaaggctgagacaaccgtcccttttgtggtggcctgaggggattttcttaatcccaatgttgccctgaaatttatgtccaggattcaaaaagtttaggactgctaagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaaga

SEQ ID NO: 27206 - DNA, 1694 bp, Homo sapiens
cgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaa

SEQ ID NO: 27207 - DNA, 1871 bp, Homo sapiens
atgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaagaataataaattaatgtttatgaatgaatctaatagattaaaagataattatggcactatataatttatgaagctttatcttcaccaaataaggcaaaacacttgtgtcattccttaatcagacttaaaacctcagaataatagcttagattattacatagattggcatcagaatgataaacacagggtaaatgatcttagagcaaaagcatccatggaggtcctgtctaattaaggaagactgaatgaaacccctttccttcagtgaagttccctattcttccccttggtatgaaagattcttagcttggatgcatccaggatttgtctcagtaagtgagcagcttgaagtttcaagctctcttac

SEQ ID NO: 27208 - DNA, 1409 bp, Homo sapiens
atgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggagattttcgtttgacaacttttcaaagatttgaggtaaatggtatccctgaagaaagaaaactgactgaagcaatgaatttataatcagacaatatagcagttacatcacatttcttttctcttccaataatgcatga

SEQ ID NO: 27209 - DNA, 1666 bp, Homo sapiens
ggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaa

SEQ ID NO: 27210 - DNA, 1624 bp, Homo sapiens
gttgctgaagcttcatcctttgctctcattctgtaagtcatagaaaagtttgaaacattctgtctgtggtagagctcgggccagctgtagttcattcgccagtgtgcttttcttaatatctaagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagcaggaatgggccacttgtgtgtaacaaaagatggactgcgcttggaaggggaatcagaatttttattcccattgtatgccaaagaaatacactccagagtggactcatctctgcttctacaatcaacccagaatgtgactgtaaatgcgcgcaactcagaaggggaggtcacaggcaggttaaaagtcggtcccaaaatggtagaagtccagaatcaacagtttcagatcaactccaacgacggcaagccactatttactgtagatgagaaggaagttgtggttggtacagataaacttcgagtaactgggcctgaaggggctctttttgaacattcagtggagacaccccttgtcagagccgacccgtttcaagaccttagattagaatcccccactcggagtctaagcatggatgccccaaggggtgtgcatattcaagctcacgctgggaaaattgaggcgctttctcaaatggatattctttttcatagtagtgatggaatgcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacaaccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatcttgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagtt

SEQ ID NO: 27211 - DNA, 1415 bp, Homo sapiens
atcctttgctctcattctgtaagtcatagaaaagtttgaaacattctgtctgtggtagagctcgggccagctgtagttcattcgccagtgtgcttttcttaatatctaagcacaaagctgtatcatcacaacctgtaggatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagcaggaatgggccacttgtgtgtaacaaaagatggactgcgcttggaaggggaatcagaatttttattcccattgtatgccaaagaaatacactccagagtggactcatctctgcttctacaatcaacccagaatgtgactgtaaatgcgcgcaactcagaaggggaggtcacaggcaggttaaaagtcggtcccaaaatggtagaagtccagaatcaacagtttcagatcaactccaacgacggcaagccactatttactgtagatgagaaggaagttgtggttggtacagataaacttcgagtaactgggcctgaaggggctctttttgaacattcagtggagacaccccttgtcagagccgacccgtttcaagaccttagattagaatcccccactcggagtctaagcatggatgccccaaggggtgtgcatattcaagctcacgctgggaaaattgaggcgctttctcaaatggatattctttttcatagtagtgatggaatgcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacaaccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatcttgtccgtgtgggcacacactgagtgttgagttgccgtgtggagttaatgtatgacgctccactgtggatatctaatgccctgttgagagtagccttgctcagtact

SEQ ID NO: 27212 - DNA, 1097 bp, Homo sapiens
acattctgtctgtggtagagctcgggccagctgtagttcattcgccagtgtgcttttcttaatatctaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagcaggaatgggccacttgtgtgtaacaaaagatggactgcgcttggaaggggaatcagaatttttattcccattgtatgccaaagaaatacactccagagtggactcatctctgcttctacaatcaacccagaatgtgactgtaaatgcgcgcaactcagaaggggaggtcacaggcaggttaaaagtcggtcccaaaatggtagaagtccagaatcaacagtttcagatcaactccaacgacggcaagccactatttactgtagatgagaaggaagttgtggttggtacagataaacttcgagtaactgggcctgaaggggctctttttgaacattcagtggagacaccccttgtcagagccgacccgtttcaagaccttagattagaatcccccactcggagtctaagcatggatgccccaaggggtgtgcatattcaagctcacgctgggaaaattgaggcgctttctcaaatggatattctttttcatagtagtgatggaatgcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacaaccacatctgcctctga

SEQ ID NO: 27213 - DNA, 722 bp, Homo sapiens
agtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttc

SEQ ID NO: 27214 - DNA, 436 bp, Homo sapiens
ctgtctgctgctgaggcctgcagagattaatataaacggcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtaga

SEQ ID NO: 27215 - DNA, 906 bp, Homo sapiens
attttcttgctcttgagctctggcacttctctgctgctgtctgctgctgaggcctgcagagattaatataaacggcagcctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaa

SEQ ID NO: 27216 - DNA, 2788 bp, Homo sapiens
ctctgctgcgggctccccgtggcctttggaggctcggtgagtcggctccaaatgttttccatatttgttcagcctccataattcgaataccagggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaa

SEQ ID NO: 27217 - DNA, 2503 bp, Homo sapiens
gcacacgcgcgcactcgcagcctgtctgaagtgcagaggttcaggcggccaagggacccgcgccggtttccgcgggcgacctgcaaatcctgcccggggcccggcaggcgctgcgtcccggcgcgttggcagttggcgacccccctcgaatcccccctctgctgcgggctccccgtggcctttggaggctcggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctatt

SEQ ID NO: 27218 - DNA, 1218 bp, Homo sapiens
atatttgttcagcctccataattcgaataccagggcaggccgagccagccgtacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttatttt

SEQ ID NO: 27219 - DNA, 419 bp, Homo sapiens
atgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaaatccattgtcatgacttctgagctgtttgaaagagaatgttctcagaatcaag

SEQ ID NO: 27220 - DNA, 553 bp, Homo sapiens
actctgcttgaacctccttaagggtattttaacttctcactctgcttgaacctccgtccttcgggacgcaaggattcagggagcttcctttcctggctgcgagggatcttcctgagcagagctctccgggttccccggctcgcggggcccggcgaagggcaggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtct

SEQ ID NO: 27221 - DNA, 587 bp, Homo sapiens
attgtaccaggattgatgtgctcggtgcccagaaggcagtaagctctgctccctagcagccttggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaatt

SEQ ID NO: 27222 - DNA, 7825 bp, Homo sapiens
tttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagtcaactaataatttaatgggggcagagacggcagcgaggggtagagctagcgagggagagagcgagagaagcagccccgtccggggactcgcgctcacactcacgcacacacacaaacacacacacacctctccctgtgccacccagcaacacccggcctcgtcacaacaacaacagccgcggccgccctctatcctgcccgggggcccagccgaaagccagggcgactctagaggacgctgcccgcccccctctttcatttcgggaaactcctgatcagttttgtcggggtttctgggtttcttttcccccaaagtcctagtgccattgtggtgctcgttgtttacctcggactctggacgagtgagagcttggcgactttttggggggagggggcggggagtttgtcgctgcctaggcggtggaggtggctgggggtgccttctgatcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcatttttaaataggtatgaaatttcacaatgaaaataacctgtttggttaacattttgcttaataagtagagataggatggtcaaaagactctccgacaaaaacaaatccagtctctagcagttatgttgttagaatggattcatctgtgcttatttcacaatacttcatttatagcaatgcttttccttaagctaatgtataaatatttctaaaggccattaatagtaacaaaataagtaggggaaaaaatggaccttctgtataaaaaccccttagcttttttttttcacaagttataagtggaataagttaataactgagctcgtaagtgtatctcataactataagagctacatgaagaaaataggaataacacacctggtatttaaacacaatcttcaaaattcttgcaacattaaacatagtaaaatgccagaatataaaatgaggtgtgctaatggtcacaggattgaggccagcattacagtttggggtgatttttcttttatttgctccctcactttgtttcctagatgctagtaggggtatctgggttgcttgagataccattttgcaattgccccttctctttctgcctaccatcttctcaggccctgatgagcttattggtaggcaactgggctgctttagtgttgaacttgtactttagaaactgaagtggaatcattgaaaactttcaataaagctttaaagttccatttacttttgaagcacagctaagctcctctgaaggcagctggtttgttgcaaacttaaaattgtactgaaaagttgccactttttatttagtaagaaaacaaacattctggctcactagagttcagaaaagtaataatttgagccaaaggaatttgaattaagaaaatagaaactaggtttcatgtatttaaaaaataggaaataaaatagaaactcaaatgccatgaagttatcttcctcttccttatatcccctaagtttgggttgcaaataactttccaattcctaataacctaaattattttgaaatagtgttttcagtgaaatgatgaatgtttgaatgtttgtttggtaatcaacataacaatgctaacaaaattcccacttagattttttaacttttaaaagtcagcgtggttttgataatttgatattttaaatgcccacacatacacacacacacacacacacacacacacaagcacatgttaataaactgataggatggagtgagcaaaattgttttcagggaagatggcacattttagaaaagacttgcccagatgatcttccatattgctcccccaatgtcatttatcgctcatgccaatcctcctcttgttacctgtggctatggtaaaattcctttaacaagcttcattgtgtccaagtatttcagagacttttaaaagctgggcatgacatagcgttttgtgctgttaagaccttagcagagtcaggtagtttacgggtaatattcaaccttgtgcatctgaatctgtcatggattcccttcactcagcactttgccactaatttgtattacactctgtggccatataatacttgcacattatgcaaaaaaaaatgttgatagtatctccttgccacacaatatgcagagttgacaacctttgaaaaccaaggtaactaatatgtatgtcctagttgtgtggcgcttggtaacaaagtctgtacatattatgtataaaatgtgtattggttagcatttagtactaagaaattctgagtttaaaataagtgatttttttcaaagtagcgatatctatatctgtgtttatctaaaaatactggcttgaatagaaaacattctcagatgattcaagattgagtaaaaatgagaatcccatacattccattattaaattctgccctattcccaattgttagcatctggctgatattaaggtctttgattgtcacaatattctcaataaatgagacattctgaactgcctggtgatattttcaaaaagagcaattaaaatgtgtattccctctaatacagctgatagaactgttgtgttaaagcaagttggaaatttgcatgatagtgtggaaaccaatggaggtccaaaatattaatcatatctaaaatatcagaaaatatcaatactagtcttctttatgcatatttttgactttttaagagggcttatgaattcaatgtttcttctgaggcaatccttttaatgtaaatactaaatacttgcatgtcttttgacaaaggctaaactacaatctattaatatgcacatttttgataaaatataaagtaccctaattaaagaaattgtggtagaaggtgtatgtcctgaatactatacctgtttaacaataccaaatgttaaataaaaatagtttgaaattaatgtttaaaagatga

SEQ ID NO: 27223 - DNA, 583 bp, Homo sapiens
atttggggatgtttctgccttgctagcagtgccagagagaacttcatcattgtcacctcatcaaagactactttttcagacatctcctgtagggctagattcagagagcagcttctgatatttggaggatcttgtaacctcgtaatatggctcttaaaaacgcactagtattcccactttctgaagtttgtagaagctgctatatatttctgtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctg

SEQ ID NO: 27224 - DNA, 975 bp, Homo sapiens
ctccttctcttccttcccttggccccgcgcgctcgctcgctcgctcctcgcctcgctctcccctttaaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgacagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttacta

SEQ ID NO: 27225 - DNA, 579 bp, Homo sapiens
tttttgcaccattatgcattcctacttctccctctttctttaagcatggagaagcctacttaaccttattataacaataacagaataggttattaatatttaatatgcacatgattaaaatttctctcccttaaacataggtcagctgtattattactaaccggcatgtaatttttcatttaaaatattggtattctgccccatgccgtttctgaaatgcagtctactttagtagtgatttaatacacaacgtttagaaaattgtggtcggctagtgagaaaagaatttaccagtcatggataatcaattatgcatgaattcagatgtaacagatggaatctggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaagg

SEQ ID NO: 27226 - DNA, 464 bp, Homo sapiens
tcctcctccgccgccgccgccgccgccgccactttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaact

SEQ ID NO: 27227 - DNA, 939 bp, Homo sapiens
ttattaaagtgtttctgctgtattttgtaatgtgtttctaattgttaaaaattgggactacgtaaatgcaatttgctgttttctttttagctatacttgtaataattcttgttctaaaagtaagcccatttttccccacttagtttttttataggccagttatctttttattcatgtgtattggtacagtttccacagatcattttgttaatttgaataagaatgtaatgctatcatctagaaatatagtaacatctgtatcatatctagataggccattttacaaatacattatatttgtggagagatatctagagctaaaacatttacataggacacatatatacacgtaggtccccgcccaactataacgtgtcttctttttaaattctggcaggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacaggtg

SEQ ID NO: 27228 - DNA, 2968 bp, Homo sapiens
agagctatgacctgatttgtgacgcaccctcagaactgcagtaatggtccagctgcttcacaggcaactggtaaccacctcatttggggatgtttctgccttgctagcagtgccagagagaacttcatcattgtcacctcatcaaagactactttttcagacatctcctgtagggctagattcagagagcagcttctgatatttggagggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaa

SEQ ID NO: 27229 - DNA, 564 bp, Homo sapiens
aaagtcctagtgccattgtggtgctcgttgtttacctcggactctggacgagacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagg

SEQ ID NO: 27230 - DNA, 3781 bp, Homo sapiens
cttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagagcccctctcccaccacccttgggaaaggagagtctagaggcgttttcttaccaggcctgccgacccctgcaccatggctcggtgctgctcctcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttattt

SEQ ID NO: 27231 - DNA, 5318 bp, Homo sapiens
gagagagagagagagagactgagaaagtcgaactcgagcttaggtaaccaacaaacccaattactaggctttattgatactaaaaggaaaagttcccctcgtaaaatttctctgagcttattagttatttaaatcagccccagggttggacgcgtgacgccgaaggcaccttctgtcggctcctggaggtgagcagccagcgtccctgcgccgacccacagcccctcgctccgtcctgggcacttggggcgaaggcgggcgcagcgagccgagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaat

SEQ ID NO: 27232 - DNA, 5730 bp, Homo sapiens
aaattattattttgaaggcgctagatctggggaccgaaagggggagggggagaaatcggaaaccgaggacaacccaaaaggactcactttgcctgatgactcaacgcaactaataatcatctccctctcagtgtgtctctctctgcggcttgtcagtgagtccggctctggctgctggcagaggcggccgagaggggagaggctggaggtgacagcttgggcggccgccgcgtttcctcccgcgcgcggtcccgggtccctgcgtcttctcggctcttggtgttaccggtcccaccgctctggccgcgcctcctcgcgagctagccgccctgcgaaccagcagccccggctcgccgccgccgccgccgcctccgggttctcagccctttctctccagaacgggtctccttcccgaaggtgtgaaaaggctctttcagcctccttctcttcccccctcctccgccgtcccctcccccgctcgctcgggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatga

SEQ ID NO: 27233 - DNA, 2135 bp, Homo sapiens
gcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaa

SEQ ID NO: 27234 - DNA, 2656 bp, Homo sapiens
agaggcgcttaagttaccaagggattagggctgatctcaggagaggtaaacgaccatccttggaacacggagcccttcttccctgcccggtatctgcgcgtgccttgggtagtccgcacaaccctccccagctccggatgccctgggatacccggacccaggagagagcgcgtcagcggggcgcagctactttgcactcgccgattctgacacaacagatagttaattggggccttcgaaatcaaggactaagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttcttt

SEQ ID NO: 27235 - DNA, 2987 bp, Homo sapiens
ataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacatacccttt

SEQ ID NO: 27236 - DNA, 2996 bp, Homo sapiens
gtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttc

SEQ ID NO: 27237 - DNA, 2650 bp, Homo sapiens
gtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacagatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaa

SEQ ID NO: 27238 - DNA, 2433 bp, Homo sapiens
agtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagtta

SEQ ID NO: 27239 - DNA, 2681 bp, Homo sapiens
gtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttc

SEQ ID NO: 27240 - DNA, 3317 bp, Homo sapiens
gttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgc

SEQ ID NO: 27241 - DNA, 3317 bp, Homo sapiens
gttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtaggtaacttggagacacggcaggatgtgcccactagcagttctcttcgtgttagtgtggcagccgtgccagttccacatttatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgc

SEQ ID NO: 27242 - DNA, 2570 bp, Homo sapiens
gttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgc

SEQ ID NO: 27243 - DNA, 3005 bp, Homo sapiens
gttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgc

SEQ ID NO: 27244 - DNA, 844 bp, Homo sapiens
gctatagctgccggcggtgtgcgactgagtcggtggcgaagacgggaacgcgacgatggcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccaggtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgta

SEQ ID NO: 27245 - DNA, 3510 bp, Homo sapiens
aggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagt

SEQ ID NO: 27246 - DNA, 1807 bp, Homo sapiens
gggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccgcgcgccggagcatgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatg

SEQ ID NO: 27247 - DNA, 1495 bp, Homo sapiens
ctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacaggtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcct

SEQ ID NO: 27248 - DNA, 2611 bp, Homo sapiens
cccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaa

SEQ ID NO: 27249 - DNA, 3125 bp, Homo sapiens
tccggcggcgccggcgatggggcataaaaccactggccacctgccgggctgctcctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaaggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccataggacatgccccgtgttgttctaggcctttgctttctgctcgttacataaatggtgaagaagagaagcgggtaagagaacagattggagccatctaaaagttctcatcttaagtgtagatcattgcaaaggatggaattttctccgattgtcatcatcgttgatgtttgaatatgagaccatttcatcagtatttaagtgtgcccgctgggatctaactaggagaggagagg

SEQ ID NO: 27250 - DNA, 2304 bp, Homo sapiens
cccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgttt

SEQ ID NO: 27251 - DNA, 2731 bp, Homo sapiens
ccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaa

SEQ ID NO: 27252 - DNA, 1883 bp, Homo sapiens
gagaaatcggggcccatgtgtgccgttggggtgagggtgcggagaaatcggggcccatgtgtgccgttgggaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacaggtgggctttgagtaatgagacctggtacttgcatcatccattcatcaagtcagcacccggggatgccaggttctgttaggggcgaggggacgtacagcagtagaggagacagctgagatccctgctcagggggattgaggggggctggcatcccagccggggagacagatgaaaaccaagtaaatcagcagaaaagataatttcactcatgataggagctgtgaggggttagagccaaatagaaatacagcgtgagccacgtgtgaggttttcagtttaaattttct

SEQ ID NO: 27253 - DNA, 2347 bp, Homo sapiens
aaatcggggcccatgtgtgccgttgggaatgtaggatggtgcagctgctgtgtggaggcccccccaaaatttaacatagaattaccatatggtggggcaaccccacttctgggtatcaaagaaatggaagtgggaacttgaagaggaatctggccaccgcgttcattgcagcgctgttcacgatggcccaacggtgggagcaacccgagtgtccgctgatgggtggtgggtaagaagctggggcccatccacacgttggaataggattcagcctggaaaaggaaggacgtttggacgcacgctgcgacatgcacgggccttgaggaagttatgcgagtgaaataagccacaacaggacaaataccgtacgattccatttgcatgagctccctagagtagccagatccacagagacagaaaagagaatgaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacaggtgggctttgagtaatgagacctggtacttgcatcatccattcatcaagtcagcacccggggatgccaggttctgttaggggcgaggggacgtacagcagtagaggagacagctgagatccctgctcagggggattgaggggggctggcatcccagccggggagacagatgaaaaccaagtaaatcagcagaaaagataatttcactcatgataggagctgtgaggggttagagccaaatagaaatacagcgtgagccacgtgtgaggttttcagtttaaattttctaatagccacttaacagtcaaaggaaacaggtggaattaattttaatcttatttaacccaaatatatgcaaagtattatcacttcaacatgtaatcagtataaacggc

SEQ ID NO: 27254 - DNA, 581 bp, Homo sapiens
ctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttggtgaggctgccc

SEQ ID NO: 27255 - DNA, 1597 bp, Homo sapiens
cgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctc

SEQ ID NO: 27256 - DNA, 4763 bp, Homo sapiens
gccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 27257 - DNA, 2871 bp, Homo sapiens
gctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttt

SEQ ID NO: 27258 - DNA, 3278 bp, Homo sapiens
ggcgcccctcctgccgccccccgcccggcctcgcactccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgaccccgcccccgcagggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgccgcgccccggcctcttggagcccacggacgccggcggtcccccgcgaagcgcgccgaggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtccca

SEQ ID NO: 27259 - DNA, 3444 bp, Homo sapiens
gggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 27260 - DNA, 3185 bp, Homo sapiens
ggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 27261 - DNA, 3405 bp, Homo sapiens
ggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgt

SEQ ID NO: 27262 - DNA, 3456 bp, Homo sapiens
actccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgcccgccccggcctcttggagcccacggacgccggcggtcccccgcgaagcgcgccggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctc

SEQ ID NO: 27263 - DNA, 3460 bp, Homo sapiens
actccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgccgcgccccggcctcttggagcccacggacgccggcggtcccccgcgaagcgcgccgaggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 27264 - DNA, 2801 bp, Homo sapiens
ttttctggggccgctccagctggtgccggccacctccactcccctttgcttcttgctgtccctaaggtcggatggggacaggctggggccaccagccagctccatggacagggactttgcctctgctcaccttccagctgtggaaagaaaagaagaaacgcctgtgttgatttccatttggaagatccttcctcctcctaaacttccaggggcagacaaagtgattcgatcttggattgactgtagaagaagggacagaaagagcccagaacattcccccagatgttccaactgtgacttctccctggcgccttgatgggagcatctgaaacacccttcaccatctagatgcacaaggaagcagagatgctaattggtccccagctggatgagaagcgctgggggtggaggttgggagatgggagtgctgcccctcccttcctcccccaagccctgtctttccttctcctcctgccactggccagcgccctacagcccactccactgccctttcaagagctgaggctggtggggggccccagccgctgccggggccgcctggaagtcatgcacggtggctcctggggcagcgtctgtgatgacgactgggacgtggtggacgccaacgtagtgtgtcgccagctgggctgtggcctggcactgcccgtgccacggccccttgcctttggccaaggccgaggccccatcctgctggacaacgtggagtgccgcgggcaggaagctgcgctgagcgagtgcggcagccgcggctggggcgtccacaattgctttcactacgaggatgtggctgtcctgtgtgatgaattcttgccaacgcagcccccaacaaggaagatgttaaccagtagagcacctcctacgacactgccgaatggaaaaagtgagggcagcgtacgcctggtagggggcgcgaacctgtgtcagggccgagtggagatcctgcacagtggcctgtggggcaccgtgtgtgacgacgactgggggctgccggatgccgctgtggtctgtcgtcagctgggctgcggggcggccatggccgccaccaccaacgccttcttcggctatggcaccggacacatcctgctggacaacgtgcactgcgaaggcggcgagccccgcctggcagcctgccagagcctgggctggggtgtgcacaactgcggccaccacgaggacgcgggcgcgctctgcgcaggcctgggtcccccaacgctcacagcactgccatcctcagccacaagagaggactgggcttggcagacagatccgtccgctacaggagttggcccccagccttcccgggagacagcactgctcaccaccgccgcctgggccgcggggaagaaaagtggacggctgcgactggtgggcggcccgggtccgtgccgcggccgcgtggaggtgttgcacgccgggggctggggcaccgtgtgcgacgatgactgggactttgcggacgcgcgcgtggcctgccgcgaagcgggctgcgggcctgcgctgggcgctacgggactgggccacttcggctacggccgcggccccgtgctgctggacaacgtgggctgcgccggcaccgaggctcgcctgagcgactgcttccacctgggctggggccagcacaactgcggccaccacgaggacgcgggagcgctctgcgcaggcccagaggagctgggactgcaagtccagcaggatggttctgagaccacgcgggtgcccactcctcggcccagggacgggcatctacgtctggtcaatggagcccaccgatgcgagggacgtgtagagctctacctagggcaacggtggggcactgtctgtgatgatgcttgggacctgcgggcagccggtgtcctgtgccgccagctgggctgtggccaggccctcgcagcccctggcgaggctcactttggcccaggccgaggccccattctcctggacaatgtcaagtgccgtggggaagaaagtgctctgctgctctgctctcatatccgctgggatgcccacaactgtgaccacagcgaggatgccagtgtcctgtgccagccttcatgacccagcccgctctgcagaccacctcttcttctgggagctgtgacctcccttcctcctccaggaagccctcctcttgtgatgactacagttcactttgcccctccttcccttgcctgggagagagcctacctagacagtgcagtcctgcttgggggagcctggctgtacccccgtccacttactgcgtgacctcagcctgtcatcgactgttgtgagcccaattcagtgaaagctcctgtggttttgctcagccaaaaccaaaacgaggggaagaggatgattcctaactcttctgtttggtggggctctttttatagcaccagactctgccttccttgacctagatccaggaggctcaggggctctttaaatggggtatctcctcttcccccaacccatcttgggatccccaagaagagggaaggcaggaggggcctacagctcctaccttgggccctcaggggctgcagaggaacctgggtccctgtcctgccctgctccgcgagggcctggactaactcagatggtgctcggctggacaaggggactgggggaggggccaaagcagggacagtggcccctccctgcagctggaaccagcatctctgatttatgccgtctccaccacagagcctccactttgcaggagtgaagaaccctgggggcctgtagccaccagttcataggtgccaagtcaataaagcattgtcccccgtctcttataa

SEQ ID NO: 27265 - DNA, 3093 bp, Homo sapiens
aagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacat

SEQ ID NO: 27266 - DNA, 2386 bp, Homo sapiens
agatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccaga

SEQ ID NO: 27267 - DNA, 3081 bp, Homo sapiens
cagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaa

SEQ ID NO: 27268 - DNA, 3096 bp, Homo sapiens
aagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagagggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacat

SEQ ID NO: 27269 - DNA, 3137 bp, Homo sapiens
aacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacaca

SEQ ID NO: 27270 - DNA, 2518 bp, Homo sapiens
ggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaac

SEQ ID NO: 27271 - DNA, 2660 bp, Homo sapiens
caagatggtctcgatctcctgacctcgtgatccgcccgcctcagcctcccaaagatctgggattacaggcgtgagccactgcacccggccagaagctttttcatttattcgtccagcagcatcttgtactagtcctgactggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 27272 - DNA, 4609 bp, Homo sapiens
gtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctgg

SEQ ID NO: 27273 - DNA, 5016 bp, Homo sapiens
agttcccgcgaccccaacgtcccagaggcggggccggagtcggcggtggcgctccttggagccggctcccgctcctaccctgcaaacagacctcagctccgcggaagttgcggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 27274 - DNA, 5225 bp, Homo sapiens
agttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 27275 - DNA, 2881 bp, Homo sapiens
cagctttatgatgagaaacacagtccagaagttgaagctggagagccttccttgagaggaataccaaatcagttaaaccaggataaaccagctcttttgagacactgcaaaccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaacagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 27276 - DNA, 5009 bp, Homo sapiens
gcgaccccaacgtcccagaggcggggccggagtcggcggtggcgctccttggagccggctcccgctcctaccctgcaaacagacctcagctccgcggaagttgcggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaacagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 27277 - DNA, 999 bp, Homo sapiens
ggaggcggcatgagcagcgcgcgacagagctgacgccgcgcccccgccggccccatgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagttaggaggtggccggcagcagccaggaggcagacgctgctgggggaggtggacgcccggggtgactgcagacagcccccaccttggacctgagctgggcaaggcccaccgcaagcatgcccccaggccagccctggctgcgagcggggccgagggacagacggacgtacagacaggcgccggcagcgggactctgcgctggccccagcacctgcccgggcccactggaactttctgcgctggcttttcttccggccactgtgtgatggcatcttgtgtttttgatatgataatataaagtctgaaaattttgtataattaaaaacaaaacagtatcttccaaa

SEQ ID NO: 27278 - DNA, 2296 bp, Homo sapiens
agagcctgtgctactggaaggtggcgtgccctcctctggctggtaccatgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggagctggagaacaacaagaccatgaaccgggcggagaacggagggcggcctccccaccacccctttgagaccaaagacgtgtccgagtacagctgccgcgagctgcacttcacccgctacgtgaccgatgggccgtgccgcagcgccaagccggtcaccgagctggtgtgctccggccagtgcggcccggcgcgcctgctgcccaacgccatcggccgcggcaagtggtggcgacctagtgggcccgacttccgctgcatccccgaccgctaccgcgcgcagcgcgtgcagctgctgtgtcccggtggtgaggcgccgcgcgcgcgcaaggtgcgcctggtggcctcgtgcaagtgcaagcgcctcacccgcttccacaaccagtcggagctcaaggacttcgggaccgaggccgctcggccgcagaagggccggaagccgcggccccgcgcccggagcgccaaagccaaccaggccgagctggagaacgcctactagagcccgcccgcgcccctccccaccggcgggcgccccggccctgaacccgcgccccacatttctgtcctctgcgcgtggtttgattgtttatatttcattgtaaatgcctgcaacccagggcagggggctgagaccttccaggccctgaggaatcccgggcgccggcaaggcccccctcagcccgccagctgaggggtcccacggggcaggggagggaattgagagtcacagacactgagccacgcagccccgcctctggggccgcctacctttgctggtcccacttcagaggaggcagaaatggaagcattttcaccgccctggggttttaagggagcggtgtgggagtgggaaagtccagggactggttaagaaagttggataagattcccccttgcacctcgctgcccatcagaaagcctgaggcgtgcccagagcacaagactgggggcaactgtagatgtggtttctagtcctggctctgccactaacttgctgtgtaaccttgaactacacaattctccttcgggacctcaatttccactttgtaaaatgagggtggaggtgggaataggatctcgaggagactattggcatatgattccaaggactccagtgccttttgaatgggcagaggtgagagagagagagagaaagagagagaatgaatgcagttgcattgattcagtgccaaggtcacttccagaattcagagttgtgatgctctcttctgacagccaaagatgaaaaacaaacagaaaaaaaaaagtaaagagtctatttatggctgacatatttacggctgacaaactcctggaagaagctatgctgcttcccagcctggcttccccggatgtttggctacctccacccctccatctcaaagaaataacatcatccattggggtagaaaaggagagggtccgagggtggtgggagggatagaaatcacatccgccccaacttcccaaagagcagcatccctcccccgacccatagccatgttttaaagtcaccttccgaagagaagtgaaaggttcaaggacactggccttgcaggcccgagggagcagccatcacaaactcacagaccagcacatcccttttgagacaccgccttctgcccaccactcacggacacatttctgcctagaaaacagcttcttactgctcttacatgtgatggcatatcttacactaaaagaatattattgggggaaaaactacaagtgctgtacatatgctgagaaactgcagagcataatactgccacccaaaaatctttttgaaaatcatttccagacaacctcttactttctgtgtagtttttaattgttaaaaaaaaaaagttttaaacagaagcacatgacatatgaaagcctgcaggactggtcgtttttttggcaattcttccacgtgggacttgtccacaagaatgaaagtagtggtttttaaagagttaagttacatatttattttctcacttaagttatttatgcaaaagtttttcttgtagagaatgacaatgttaatattgctttatgaattaacagtctgttcttccagagtccagagacattgttaataaagacaatgaatcatgaccg

SEQ ID NO: 27279 - DNA, 1749 bp, Homo sapiens
ggaagcggaacgctaccggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcggacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 27280 - DNA, 1601 bp, Homo sapiens
aggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttggatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcggacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacata

SEQ ID NO: 27281 - DNA, 992 bp, Homo sapiens
tccggggacgcctgcgccctgcctgtgagcgtgtggcgcccgctttccctgagccggcggggcagagcgcagggagctggaggtcggcgcttcctctcgtgcttggtccactgacgcgcggccccgccgcgaggtgcggacgccggggctgggaggggaggaggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgg

SEQ ID NO: 27282 - DNA, 992 bp, Homo sapiens
gctccggggacgcctgcgccctgcctgtgagcgtgtggcgcccgctttccctgagccggcggggcagagcgcagggagctggaggtcggcgcttcctctcgtgcttggtccactgacgcgcggccccgccgcgaggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 27283 - DNA, 617 bp, Homo sapiens
tcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctg

SEQ ID NO: 27284 - DNA, 568 bp, Homo sapiens
gcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctg

SEQ ID NO: 27285 - DNA, 1002 bp, Homo sapiens
gcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 27286 - DNA, 1051 bp, Homo sapiens
tcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 27287 - DNA, 1282 bp, Homo sapiens
gtggggacccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggctctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggagggg

SEQ ID NO: 27288 - DNA, 5143 bp, Homo sapiens
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggtagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcc

SEQ ID NO: 27289 - DNA, 5108 bp, Homo sapiens
gagtgaaacccgtggggattcagggaggtggatggggttagggtggaacttggattcaggtggctgatgagtactagcttcttgggccgctctggaggtgggtccagacctcctctccttttttgctgggtgcagggccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggtagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttt

SEQ ID NO: 27290 - DNA, 4168 bp, Homo sapiens
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggtagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggccccctaaggcctgggcgccgtggcctgggccctgtgccctcctag

SEQ ID NO: 27291 - DNA, 5218 bp, Homo sapiens
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggtagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgcccttgtctggaaagaagtttgactacagggcctttgcggccctgccttcttccagacctgtctatgacatccagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcc

SEQ ID NO: 27292 - DNA, 2642 bp, Homo sapiens
ctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 27293 - DNA, 2548 bp, Homo sapiens
ccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttc

SEQ ID NO: 27294 - DNA, 2300 bp, Homo sapiens
ccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttc

SEQ ID NO: 27295 - DNA, 1175 bp, Homo sapiens
gaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagcccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgag

SEQ ID NO: 27296 - DNA, 2583 bp, Homo sapiens
cccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 27297 - DNA, 2584 bp, Homo sapiens
ctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 27298 - DNA, 2303 bp, Homo sapiens
ccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 27299 - DNA, 2570 bp, Homo sapiens
cccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 27300 - DNA, 663 bp, Homo sapiens
atgataaaacccaaatgggggggtctggtgtgggcacagtggcatggccctctggcacggccctctggcaccttaccctttgccagctccatgcccagccctgtggatgcatcctcagcagacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 27301 - DNA, 665 bp, Homo sapiens
atgataaaacccaaatgggggggtctggtgtgggcacagcctggcatggccctctggcacggccctctggcaccttaccctttgccagctccatgcccagccctgtggatgcatcctcagcagacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 27302 - DNA, 825 bp, Homo sapiens
gcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacgacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 27303 - DNA, 2046 bp, Homo sapiens
gagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacgacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 27304 - DNA, 3679 bp, Homo sapiens
acacttgctcgcctcctgcctgggtctctgacttcaggagggcggagggggcccgtgtcagagccttccgcgccccagcgcatcgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctgcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcagggagtgaaattcaatgcccaccgctaggctcctcgctgcctctcactcaagaggcccaaactcagacggcgtcagggacccggacccagcagccgtttcacgccaatagatagggcgcatgcgcagaaatcctcctcggctctctagcgtgagctttcccaaggggccacgcccagcttgccttctgattggtccagctggtgggttgtcttccgccatctttgatcagggcactaaggatgctccccacggccttcacagtgacggcggagaccctgccccgccagctgctcagtacgtgccgcgtagcccgtgcgagccaagtgtgagtccgggcgagcgcctgcggagctagcactgggcccagaatgagagggaggcggaggagcagcgatcacgtggttttagggactgtctaataattccacgccagcattgccggtgtttcagggggtgggaaccgctgcgttccccatcaacttttctcccacccaccaccctccccaacctacaagcccagctcagcttgaggtaactgctgaccggactgtcctatacagccctacaagacagaggcgcctagggctgaaagcgggggcctccgtagggagccagcgggggcctcaatagttactcattttctctacctttgatgaaaataagagctaattcttaataaggcctaccgggtatcacgcaaaaaccctgtgcttactattacactttgggttgttgcaaagattaaaggaaataagccgtgcaaagcgcttaaga

SEQ ID NO: 27305 - DNA, 1229 bp, Homo sapiens
gagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagt

SEQ ID NO: 27306 - DNA, 2631 bp, Homo sapiens
gctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagccagaagcttcgacctgcagaagtcggaggccatgctccggaaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctgcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcg

SEQ ID NO: 27307 - DNA, 1733 bp, Homo sapiens
gcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgtaagtatctctgccttggcaatgccttgaagccccatgtccagctttctgcctgtgaggttcctcttcctccatggatttttggctctgagtgttagaactagaagtggaatgccatcagttcaatcctctccttgtatagatgaagaaatctagccttggagacttgtttatggtgacccaactggttaacagcagggtgggactttgatctcatactcctaggtatgggtgagtcacagtcctaggcgatcacaggggttcaacacgtctgctttctggtccaggtctaactgggtctgtgactggacagatatttcttggggatgctccttcccagaggtcacagagacagaactggctgggtgggcatgggatcacaaggtaagcagatgctcaaaagtgcagccttcacccctgagtttcactcatctcccagctgaccaaagaatggacacagactatgagcaggcagtttacacaagaatataagaatgggaaacagacatttgaaaaggtgcttaatctctcttaactttgtaataccattaaaattccccttgactcagcaa

SEQ ID NO: 27308 - DNA, 2086 bp, Homo sapiens
gggcaaaaggacccagctgggtcagggctgacaaactaggcttggcctcttgcctatagtggccaccactcctcaagccccagccagcaccatgagcggccgagttggagacctgagccccaaacaggcagagaccctggccaagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaactatca

SEQ ID NO: 27309 - DNA, 2316 bp, Homo sapiens
cagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtggaaagtgagtctgggaagtcttgctgtcatctgcccgtgattatatgcagccatgagctacagaactcacactcaaactcgcaagtgatggcataccaaatggtacgaaaatgcaagctaagtaggcctttacccctccctgccagtaactaatttttgtctgtgtgagtaactggcctgtgtgtaagaggactcaccccctacgtggtctccagttaattctttttcccatttgggctcctgaccgccttgccatgctgcttctaagaggggttatctatactcagagggcctagggcagaccaaggaagggaaagaagttttggaggtttgtttgtttgttttttagagacagggctttgctttgtggcccaggctggagtgcagtggtgcgatcatagctcactgcaaccttgagctcttgggctcaagtgattctcccctctcagcctcctgagtggctgagaccacaggtacacatcaccatgcctgggttttttttctttctttctttctttcttttttttttttggtagagatgaggtattgttacattgcccaggctggtctcaaattcctgacctcaagcaatcctcctaccttggcctcccagtgctaggattacatgtgtgagccaccactcctggtctgggctttttttttttttttttttaggagaatgtaaggcatttgtttagtgtttactgagcatctactgcatgccaagctctgctcaggaggccaagagagcaggataggagtgagccctgcacctggggtttggcctggctggggagccctagcctcaggaagcaggactgccctggaccccaggaggcccctgctcaacctgcgacaagactgaaaggctccccagatgcactgtgacggtcaagggagagaaatgggtgacctgggatcctggtggcttcagatctcattgggggaaggagcaagggaccccaggggtcagaggcattgggggggtagggctgtcagagggcacccagcagagtgactcacaggctatgaggaaagaagtctcctcttgcttgtatcttcaggatgccaagacctgcagcccaggcctggggtggtggttatcccggagcggccttaccaggtgcacagctggccaagggaggcttggtcatgggcagagagggcaggaggaaggcccttgctccaccaccccctctcccaagggagtcctatgcccagaacttaccaagtagcaagactagagcaaccagcagaagacccttgggggcagccatcatg

SEQ ID NO: 27310 - DNA, 1864 bp, Homo sapiens
caccactcctcaagccccagccagcaccatgagcggccgagttggagacctgagccccaaacaggcagagaccctggccaagatggagtctctgtcatccaggctggagtgctgtggagcgatctcagctcactgcagcctctgtctcccaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 27311 - DNA, 1837 bp, Homo sapiens
cagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagagaaagggacacgggagacatcaggggcagacctaagaagtccaagggcctgctgagacctggctttgccatttaccctctgtgagcaaggccctcccctgcaggacctcagctttctcacctgagacaatagcactgtcttccagggagggacagtgctttttataccatggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 27312 - DNA, 1964 bp, Homo sapiens
caccactcctcaagccccagccagcaccatgagcggccgagttggagacctgagccccaaacaggcagagaccctggccaaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagagaaagggacacgggagacatcaggggcagacctaagaagtccaagggcctgctgagacctggctttgccatttaccctctgtgagcaaggccctcccctgcaggacctcagctttctcacctgagacaatagcactgtcttccagggagggacagtgctttttataccatggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 27313 - DNA, 2499 bp, Homo sapiens
acaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 27314 - DNA, 1603 bp, Homo sapiens
cggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggca

SEQ ID NO: 27315 - DNA, 2575 bp, Homo sapiens
atctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggatcctcctccgctcagttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtgcggggtttgtgctccctgatcacctctccatcactgcagatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 27316 - DNA, 2564 bp, Homo sapiens
atctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggacccaagtccccccagcccacctcctgtccccacgctctgagagcctggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 27317 - DNA, 3910 bp, Homo sapiens
ccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 27318 - DNA, 6556 bp, Homo sapiens
atgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcga

SEQ ID NO: 27319 - DNA, 8806 bp, Homo sapiens
tccagctccaattaaggaacagctatatcctgcttccttctgtaagcagcatcgacttgtgcaagggttcagtcatgcagccaccgccccagacggtcccgtctggcatggctgggccacctccagccgggaatcctcggagcgtgttctgggctagcagcccttacaggagacgggctaataataatgcagcagtggctccgacaacttgcccgttgcagccggtcacggatccatttgcttttagtagacaggcgctccaaagtacaccactgggcagttcgtccaaaagcagtccacctgtcttgcaaggcccagcccccgcagggttttctcagcaccccggtttgcttgttcctcacacacatgccagagatagctctcagggaccctgtgagcccctgcctggacctctgacacagcccagagcacatgccagtccgttttctggtgcattgacaccttcagcacctcctgggcctgagatgaacaggagtgcagaggtcggtcccagttcagagcctgaagttcagactctgccatatcttcctcactacattccaggagtggatcctgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttc

SEQ ID NO: 27320 - DNA, 3073 bp, Homo sapiens
gtctctggatctgcttcccacctccatcctcctggtgtctctgtggatctgctccccacctccatcctcctggtgtctctgtggatctgccccccacctccatcctcctggtgtctctgtggatctgcccccgacctccattctcctggtgtctctggatctgctccccacctccatcctcctggtgtctctgtggatctgctccccacctccatcctcctggtgtgtctggatctgctccccacctccatcctggtgtctctatggatctgctccccacctccatcctcctggcgtctctgtggatctgctcccacctccatcctcctggtgtctctgtggatctgccccccacctccatcctcctggtgtctctgtggatctgctcccacctccatcctcctggtgtctctgtggatcgccccccacctccatcctcctggtgtctctgtggatcgccccccacctccatcctcctggtgtctctgtggatctgctccccacctccatcctcctggtgtctctgtggatctgctcccacctccattctcctggtgtctctgtggatctggcgactctggggcctcacagaaggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagc

SEQ ID NO: 27321 - DNA, 8093 bp, Homo sapiens
tgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 27322 - DNA, 3517 bp, Homo sapiens
ggtgcgtgccaaggagctgagggtttagctcgcaggatgagcgtgtgttcagctttaggagacactgctgagcagttgtcctaaatggttggttgccccaagtcacacatcctgcagcagaggacaagggccctggatatccctcatcttcaccaatactgggcagtgccggttctttaacttagccattgtgctggggctgatgacatctcattgtgtcttcctctgcatctccacagcgaggtgtgacgctgggcaccttctcgtgtccctgttaccatctcaccactcttttggggcagtgcttgttcaagtctctatccgttgttttttttttcccccataaagatggggtctcactattgcccaggctggtctcaaactcctgggcccaagtgatcctcctgcctcgtagctgggactgcaggtgtagccaccacacctggctttcctttccatttttaatggtgttctcttcaggacttgcaggagtcctttctgtattatggatataagtcctctgttaggtgtatttattgtgatatcttctcccaatctgtagattgcctttttacttgtaatggttttttgtttgtttgtttgtttgtttgttttgagacagggtctcactctgtcagccaggcagaggttgcagtgcgccgagatcgcgccattgcactccagcctgggggacagagcgagactctgtctcagaaaactaacaaaccaaaatgaagtgcatcatgtgaagaataaagtaaagtttcctaataaccgaattctccacacatgggaaacacagagggctgtatctgcctccgacacacactgacttggacagcccgccttccacttctcaaaggggaggacgtcggaagctttgtcagtgtttagacgtaaaaagttcctgaaggcacgttactgttctgacctatttaaatgacagtaaaatacacagaacaaaatgcacatttttaccattttctgagtgcacagttctgtggcaccaagtacattcacactgttgtgttgccatcaccaccatccatctccagaactgtctcaccttcccaaacagaaactctgtctccttgaaacgaaacaactcccggttccctcccacctccatcctcctggtgtctctggatctgcttcccacctccatcctcctggtgtctctgtggatctgctccccacctccatcctcctggtgtctctgtggatctgccccccacctccatcctcctggtgtctctgtggatctgcccccgacctccattctcctggtgtctctggatctgctccccacctccatcctcctggtgtctctgtggatctgctccccacctccatcctcctggtgtgtctggatctgctccccacctccatcctggtgtctctatggatctgctccccacctccatcctcctggcgtctctgtggatctgctcccacctccatcctcctggtgtctctgtggatctgccccccacctccatcctcctggtgtctctgtggatctgctcccacctccatcctcctggtgtctctgtggatcgccccccacctccatcctcctggtgtctctgtggatcgccccccacctccatcctcctggtgtctctgtggatctgctccccacctccatcctcctggtgtctctgtggatctgctcccacctccattctcctggtgtctctgtggatctggcgactctggggcctcacagaagtgggtcatgtagaatttgtctttttgccctggcttatttcatggaacataatgttttcaaagttgttctcgtgttttttatatttagggtgaatcctggttctttcgttggctacctggaaagaaaaagacagaagcttatttgccagatgacaagaacaaatcggtgagtgctgtcaaatacgcacgggacgtccgaagaattgtaatgatttttctgtcactttcagagcagacctgagtaggtgtttcctgaagttttgaagtgtcatcattaatcagatgctaattctgtttaggttcagtctgctgaccttttttctttttaaaatcttggcagattgtttgggatgaaaagaaaaaccagtgggtgaatttaaatgagccagaagaggaggtaaattgtcattctagttcctgttgggtgtgaggtgtgagtggagggaacagcctcatgtggccctgtgatatttgggtggctgttgccccttttggagcctcctgactgtgccatcccagtgggtttctgtgcacacagtgggtgtctgaagctgtgtttccctctgcagaagaaagccccgcccccacctccaacctcgatgcccaagactgtgcaagctgccccgcctgccctcccagggcctcctggagcccccgtgaacatgtactctagaagagcaggtaagggtggccttggagtgggagcttgcttgaacgattaactgtcccagagagagaggccaatgtgtagctgttgtgcgtggggaggaggtggcttcccgcacgtccctgcgtgcttttcctctgacgcagtgagcgcagagcatttggaagctggaggccacctggcgcgttcacctcaatttgcttccctcccctttgcagcaggaaccagagctcgctacgttgacgtcctgaacccaagcgggacccagcggagcgagccggctctcgctcctgcggactttgtcgctccactcgcgccactcccaattccttctaacttgttcgtgccaaccccaggtaggtagcacgagcaccagcccctccaggtcagcccccagtctcctgacctttgatcctctttctatgagtctctcctaaatctcccgttaaaagaatgacctggccagcatgcagagagcctggggttggtttgtggttttttttttgatttgcctgtttctgcatgagtgtgccgcgtgtgcagtgtgaaactctcttcctctcggagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggtgagcgggtacggtgggaaaggggaaaggtacccagtgaggaggcacctccccatcctgccagacagggccttgccttctgcaagtcagtatccaatgtgtacgtagagtgttccgccttaaacgcctcacacttatgtatggtagagacggaaggtagaatgcagggtgccgggcgggacagagctgtttgggaagacggagatctggggatagtggcggtgatggttgctcagcacggtgaatgtgcttaaaacttaaaaatgattaaagtggcaaattttacagtatgtatattttacaatttttaaaattggaaaaagtaaaattaattactctaagttacagagaaattacctaccgataataaaagttaagtatattttcatcc

SEQ ID NO: 27323 - DNA, 3671 bp, Homo sapiens
ccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcga

SEQ ID NO: 27324 - DNA, 5260 bp, Homo sapiens
atgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcga

SEQ ID NO: 27325 - DNA, 6541 bp, Homo sapiens
atgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcga

SEQ ID NO: 27326 - DNA, 3169 bp, Homo sapiens
ctctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaa

SEQ ID NO: 27327 - DNA, 4834 bp, Homo sapiens
gctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 27328 - DNA, 2097 bp, Homo sapiens
ctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttc

SEQ ID NO: 27329 - DNA, 4228 bp, Homo sapiens
ctttctgtttaaaattttgcctggatttctgattatttttctcaagacaggtatatatttaaatttattgaggttaaaaggtatgccttcagactcttgttgaaattgccaaatcattttgagaactgtttgtaccagtttttacttccatctgtacttatgagaatgccagacagaagtattattttttaaaaagctaatgtggctgggtgtggtggctcatgcctgtaatcccagcactgtggcaggcgcctatagtcccagccacatcctatgctgtggcatgggaacccaggctgaggcatgagaattgcttgaaccctggatgggggatgttgcagtcagccaagatggcgccactgcactccagcctgggtgacagagcaagatgctgtctcaaaaaaaaaaacaaaaaacaaaaaacaaaagctatatgttaagtgaagcatagtatgttgttttaattagttttttgttttttttttcctcctgagacggagtctcactctgtcgcccaggctggagctcagtgacgcgatttcggctcactgcaacctctgcctcccgggttcaagcaattctcctgcctcggcctcctgagtagctgggattacaggtgtgcaccaccacgcctggctaatttttgtatttttagtagagaaggggtttcatcatgttggccaggctggtctcaaactcctgatcttgtgatccaccctcctcagccacccaaagtgctgggattacaggtgtgagccaccacacctggccattttaattactattcttatattactagtaagttgaacatttttacatatgcttatcaagtttggctttaatttttatgtaacccaaattgttcattttgttttaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccgtaacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatatcagattatttgcacacttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcacactatagccgttgtttcccaaacttcagtctctttagtactacttgtattattttcttaatatttatcttttaaattttaaagtttttttaaaaaaatgaatcctgctccaagtggaaaaccagtatcagtttgccataaataaaaggtaaccacaaaataagtaagatgaacacaaaaaatgttgttcagttctagctagaaactaatgcctagaaaggctccgaatcttaggctctttctttgtggcagtgagggagatgttaccagcaccagcatgaggcactgtctctggaatagtcagaggataaaaggaaactgtaaagggaatgacattctcactgtgattcagcattattctatgttgtgcatcacttaaagacatgttgtgtgccaccagtggcatgggtccgcactatggaaatgcttgactgtagtaagaatcagaaggtggctttcctagcaactcattattttatggctttgaggaattaagcccctagtatctgagagaacttacttgttttttgataacgttttaaagattgtttaagcagttatgaattaataatataggaagcacagttggattccactagcaaaatctataactctcatggttttggaagtcatcttcatgggtgattttcctttgttttttaaagaaaatatttcaaacaaggaattcataggatactgaaatttgatatcatccagaaaaacagatcccattacattgtaattgttgttactaggcatatttattaagtagagaaatagagggtaaaaagttagtgaactgtcttgtttgcgtgaaccagtatttgtggatatgtctagaactgtaaaatcttgcttaactagaaccttagtctgcaccctccttttaggagaatgaggtaaaaggaagacaataagcttatgatatcagggattcatgtaaaacaggaaatagtagttggctccagtcttctcctctaacaaaagtatgcatattctgagagataccccaaggcatcacaagatcctgaatcatcaaaacaccattgaattgtgttgggcattttgtagccaggaaagtgaagtggttcaatttagaaagggtttcaggccaggcacggtgactcaggcctgtaatcccagcactttgggaggccgagacaggcagatcacttgagaccagtagtttgagaatcagcctggccaacgtggtgaaacctcatctctactaaaaatacaaaatttagctgggtgtggttgcgcgtgcctttagtcccagctactcgggaggctgaggcaggagaatcgcttgaacccaggaggtggaagttggcagtgagccaagatcacgccactgtactccagcctggccaacagagcgagactctgtctcaaaaaagaaaggttttctaaactaatggttaaaacagaattttcttgtaaatagggaagttggagcattctggttgagattttgctctgtattgacacagctcgcaccagtttggttcaggagctacctccttgtcattgaattgacgagttacaatgtttggtattcggatacattcagcaagaacacttgaaaactcctcaccaactatttttaaaggcttactttgtttttgtttttattttttcactggctattttggataagaggatgtttacatcttaatgtaaaaaaatgaaaacaggtataaatgttttatgta

SEQ ID NO: 27330 - DNA, 572 bp, Homo sapiens
agtcctcttcttcctttcttaggggtcgttcgaatccctgccggcctctcccctcccgctccctgcctctcgccacagcctcggccttcgccctcgggattgaagacctaccccacgggcaggagccaattgctgatggggagaggaaaaaatagccactattcaggttccctgtgagttaactgctgctgtacaaaggcaggtgtaatattttctctgtattaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagacc

SEQ ID NO: 27331 - DNA, 1011 bp, Homo sapiens
ctcggagcggcgggtcccgtctcgacagttgctgatggggagaggaaaaaatagccactattcaggttccctgtgagttaactgctgctgtacaaaggcaggtgtaatattttctctgtattaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgt

SEQ ID NO: 27332 - DNA, 550 bp, Homo sapiens
ctttcttaggggtcgttcgaatccctgccggcctctcccctcccgctccctgcctctcgccacagcctcggccttcgccctcgggattgaagacctaccccacgggcaggagccaagtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatcttt

SEQ ID NO: 27333 - DNA, 870 bp, Homo sapiens
ctctcccctcccgctccctgcctctcgccacagcctcggccttcgccctcgggattgaagacctaccccacgggcaggagccaagtccgtgcctttgggatgggagtcggggccgcggagctctggagttgctgatggggagaggaaaaaatagccactattcaggttccctgtgagttaactgctgctgtacaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctg

SEQ ID NO: 27334 - DNA, 482 bp, Homo sapiens
tttcttaggggtcgttcgaatccctgccggcctctcccctcccgctccctgcctctcgccacagcctcggccttcgccctcgggattgaagacctaccccacgggcaggagccaagtccgtgcctttgggatgggagtcggggccgcggagctctggaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatga

SEQ ID NO: 27335 - DNA, 972 bp, Homo sapiens
actcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctga

SEQ ID NO: 27336 - DNA, 4135 bp, Homo sapiens
acgctgtggctttagggagctgggaaaggcgctctctcccggtcccgctctgcccggtcccacgcccctcggccgtccggctgcctgggtcttccgggttcttccgcccctctggctcggtccccgctacctctcctccctcctcccctctcggtaccttcgcccgccgcgcgcctttctcaaatcctccggttattaagcaagctcaggggtccggtggcctgccctggtaactctgcgcccgccccttcctgcccccttcctgccctcacgccccgtcccctcctcttgacgtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgt

SEQ ID NO: 27337 - DNA, 2685 bp, Homo sapiens
agtgaggaaagggccgcctcgtctccgctcctgggggaccgcagtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagaggagagacttccctaaaacctctggtgagatcctggagaaccaggaaaaggcaaggtctgcttgtcttaagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttacta

SEQ ID NO: 27338 - DNA, 4215 bp, Homo sapiens
tctcgctctgtcacccgggctggagtgcggtggcacgatctcagctcactgcaacctctgcctcttgggttcaagcgcttctcttgcctcagcctcccaagtagctgggattacaggagcataccaccatgccttactaatttttgtatttttagtagagttggtgcttcaccatgttagccaaggttggtcttgaacttctgaccttgtgatttgcccaccttgacctcccaaagtgctgggattacaggcatgatccaccgcacctggccctaatttttgtatttttagtagacatggggtttcaccatgttggccaggctggtcttgaactcctgacctcaggtgatccacccgcctcggcctcccaaaatactgggattacagctgtgattcactgcgcctggccacatcttccttttttcaataggcaagtgaatgcctgcagactgaattttttttctccattgaaacatgtttattttctttccctatttagattaaatttccctattctttccctattattagttgaaaagagcctggcctttgctccccagatagtcctggattcaaatcttaaactcttctggttgtatgatcctgggtttttgtctttgctgattgtgtcatccttcatagaaaggaataaactacctattttgccaggttattagtactaaatatgaaattctcaatatggtgtaaacccttatagagctttatagaaaaacctggatttaaaatcttgctttgttacttactgattgtgtaacctcagacaaattacttagtctttctgattgtcaattttcatttataaagtagaatttaagaagaaatctatttcattattgttttgtgaggaaatagtatatataaaggttttagcatagaatatggaacatattaagttcttagtaaagagttgctgtttctgctaacagtataggaaatattgcaggattagttcactaattttatctttgtacatctttagacttcagttttctgttacacagttttataactccagtacttcatgactaagcatttctagattcaagaaaaatttagtataacattattttcatttgtctagagagaaattgtgcacatatctgaaattcaaaacaaaggtggcagttcgtagtttggttatgaattacattagaaaatcaagatgtatataggtacaaagaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 27339 - DNA, 2734 bp, Homo sapiens
gtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgt

SEQ ID NO: 27340 - DNA, 588 bp, Homo sapiens
gtgattctcggaatcaaccagggtcctaagatgtcctggaggccgtctccatttctctcgaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattactttt

SEQ ID NO: 27341 - DNA, 547 bp, Homo sapiens
gttctccttcctcagcctccggagtagctgggattacaggcgcatgtcaccatgcccggctaatttttgtatttttagtagagacggggtttcactgtgttagccaggatggtctcgatctcctgacctcatgatccgcctgcctcggcctcccaaagtgctgggattacagatagatgtgatttgtgattctcggaatcaaccagggtcctaagatgtcctggaggccgtctccatttctctcgaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcaggt

SEQ ID NO: 27342 - DNA, 571 bp, Homo sapiens
ggcagaggcggcgccagccatgttggccgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaaga

SEQ ID NO: 27343 - DNA, 575 bp, Homo sapiens
aggctgactaaaatacataaatagtacgtgaattctttcgggccagggatctgggcctactttgcctgcatcatattaccagcatctcaattgtgtctggcacatagtaagtttcagtaaacatttgttgcactaagtgaaagaatgaacttttcacttttttcagagatgtgatttgtgattctcggaatcaaccagggtcctaagatgtcctggaggccgtctccatttctctcgaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagcc

SEQ ID NO: 27344 - DNA, 3176 bp, Homo sapiens
atcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctaggtgagcggctccggccaggtgagcggggcgcataggtgacggagggccgagggcacggttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctga

SEQ ID NO: 27345 - DNA, 3411 bp, Homo sapiens
atcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 27346 - DNA, 3229 bp, Homo sapiens
gcttctgggaggaggccttttcttgacagtttagggtagcgggggaatggatgatccgggagtcccctgcggatgtcgtcccgcaccaggccgggaccgatttctggctccagtttccccagaattgcggagtgcgcacacctggaaggacccaagtcccgttttatagttgagaaactcaagactcagacaagtgaaacgacttttgcttcatgacagctggaactggaacccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 27347 - DNA, 3405 bp, Homo sapiens
aggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 27348 - DNA, 834 bp, Homo sapiens
cagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagat

SEQ ID NO: 27349 - DNA, 1184 bp, Homo sapiens
cttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacgttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaag

SEQ ID NO: 27350 - DNA, 6568 bp, Homo sapiens
aggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcggcctcccaaagtgctgggattacaggcatgagccaccatgcctggccagaataatgtttttaaatgcagaaaaggaaatgcatggggttacaagggaaacgaattacactgaagtgtaagctaccaaataatttatgatgtggtagttataggtgtgcatttaatagccagatctacgagtggatgtaataactgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagcaa

SEQ ID NO: 27351 - DNA, 1430 bp, Homo sapiens
ggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgtta

SEQ ID NO: 27352 - DNA, 947 bp, Homo sapiens
gggaaccgggcggagcggccaacatggcggaacgcaggagacacaagaagcggatccaggaagttggtgaaccatctaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcag

SEQ ID NO: 27353 - DNA, 6411 bp, Homo sapiens
cggcggcggcagcggcagaggtggcggcggcgtgtccgtgagagtggcgtgggggcggggaggagaggcggcggcggcagtgtccaagctacgccactcgggccggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaactcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactcttgaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgaatggtttttttggttctaaatttaagatgtaatatttcctataaaagggtgaaagcagtttctttctctataacctcaatcaccagtttagtgagagcctttcttggcaggcaggaggcagtgtcactgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacgaaggcaaggaaactgagcagacaagacagaacaatgtgtagaatgcatatttcctagttttcttgaaagatttcaagaaaagttgtttttttttttctagtggctactttgccttaaagaggctttataagttcattcacacagctggcttctctggttttaagattctggagaggatgataacctagtaacaccacagtgcttaaaaaaaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcgtggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttagtctatctactgtaggcagaagaattatttctttaggggctagctgtttattttgctggcctttttttctctctttctctttttcttcttaagacggagtctcgctctgtcctccaggctggaggagtgcagtggcacgatctcagctcactgcaacctccgcctcccagcttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagccactgcgcccagcctgttgggtttttttggaaaaaaaacaaaaacaacaaatcatcatcctttcctttaaaatgtttttttttttttaagaaacaattttcccacaaacggtctgatttaactccatgaaatcctctatttagactgccttaaagtgaaataactgttggtgaaccataacattttgccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaa

SEQ ID NO: 27354 - DNA, 1940 bp, Homo sapiens
acgtctcccttagcgagctcgctggggacacgcagggggagggaaaactgagcggggcgggaactatctcctctcgcgagagctggcgacggcggcggcagcggcagaggtggcggcggcgtgtccgtgagagtggcgtgggggcggggaggagaggcggcggcggcagtgtccaagctacgccactcgggccggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaactcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaaaaaaaaaaagaaacctttaaaaaaaaaacctacacctgtgctattaccacagtcaaagcaacagaaacaaaagcaggcaaatggagtcgttgggaa

SEQ ID NO: 27355 - DNA, 5085 bp, Homo sapiens
gaacatgaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactcttgaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgaatggtttttttggttctaaatttaagatgtaatatttcctataaaagggtgaaagcagtttctttctctataacctcaatcaccagtttagtgagagcctttcttggcaggcaggaggcagtgtcactgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacgaaggcaaggaaactgagcagacaagacagaacaatgtgtagaatgcatatttcctagttttcttgaaagatttcaagaaaagttgtttttttttttctagtggctactttgccttaaagaggctttataagttcattcacacagctggcttctctggttttaagattctggagaggatgataacctagtaacaccacagtgcttaaaaaaaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcgtggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttagtctatctactgtaggcagaagaattatttctttaggggctagctgtttattttgctggcctttttttctctctttctctttttcttcttaagacggagtctcgctctgtcctccaggctggaggagtgcagtggcacgatctcagctcactgcaacctccgcctcccagcttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagccactgcgcccagcctgttgggtttttttggaaaaaaaacaaaaacaacaaatcatcatcctttcctttaaaatgtttttttttttttaagaaacaattttcccacaaacggtctgatttaactccatgaaatcctctatttagactgccttaaagtgaaataactgttggtgaaccataacattttgccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaa

SEQ ID NO: 27356 - DNA, 3320 bp, Homo sapiens
ggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagaaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaa

SEQ ID NO: 27357 - DNA, 3454 bp, Homo sapiens
gctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaa

SEQ ID NO: 27358 - DNA, 3398 bp, Homo sapiens
ccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtactaatgccgctaccaattctccttcatgtacaagagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 27359 - DNA, 826 bp, Homo sapiens
ggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcag

SEQ ID NO: 27360 - DNA, 547 bp, Homo sapiens
gctgcttccaagttgtggcagttatgagtaaagctgctataaacatccatgtgcaggtttttgtgtggacataagttttcacctcctttggataattaccaaggagtgcagtggctaaatcatatggtaagagtatggttagttttgtaaggaattgctaaactattaaatatctcccaaagtggctgtaacgtttttcattcttaccagcaatggataaggatttctgttgtcaaagtgttctggattttgatatgtagtgttatctccttgttttaatttgcatttctctgatgacatctaatgtgtttgctttttagggtgaaatagtggtgaaaaataacccaaatgaatctgtaactgctaatgccgctaccaattctccttcatgtacaagagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaa

SEQ ID NO: 27361 - DNA, 3085 bp, Homo sapiens
acccagcgcagtgactgcggcccagcccggcgctccccgcagtcggggcggggggactctggcgagcttcccgcgctcttgggaacggatagattgttttaaaggatcctgcgtttttctgaacgtcattctccgctctacgtactcagcattaccactagatggagccctggcgatcgcttgcatcatttttagacccataaaattctcggtgaaaggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctga

SEQ ID NO: 27362 - DNA, 2282 bp, Homo sapiens
aaacagccccgcggggaacgcgcgccgcacgcgagctggacccgcccaggcacgaactctcctggaaaaatgctcccggcggctttcctgcttcctttagcgtgaaccgcgggtgcggtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcagggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 27363 - DNA, 2032 bp, Homo sapiens
agatttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacct

SEQ ID NO: 27364 - DNA, 537 bp, Homo sapiens
ctctcatcacttctgagcacggagcaatggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaagagtgga

SEQ ID NO: 27365 - DNA, 1024 bp, Homo sapiens
gccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgaggtgtccctcgcccttttggtttgttcaaggagctgctgctttgcatagctgctctagtgtctggtatcatcggatctggttttgaataattcccaggagtcctgggtccctggcctccaaagctggaatgtgaacgcatgccacggtggtctgaccctcacactccttttctcttaacagcaaaatgcaatggaaggaagaaaagttccaacaaagaatgattttgtgaattctgtgatttttcttctgatcagtttcaatctgtaataaatgccttatttttcctgtaa

SEQ ID NO: 27366 - DNA, 860 bp, Homo sapiens
tgctgcagtcaaaataagcagccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgagcaaaatgcaatggaaggaagaaaagttccaacaaagaatgattttgtgaattctgtgatttttcttctgatcagtttcaatctgtaataaatgccttatttttcct

SEQ ID NO: 27367 - DNA, 366 bp, Homo sapiens
atggccccccggcccctcctgctgctgctgctgctcctcgggggctccgccgcgcgccccgcgccccccagggcccggcgacactcagacgggacgttcaccagcgagctcagccgcctgcgggagggcgcgcggctccagcggctgctacagggcctggtggggaagcgcagcgagcaggacgcagagaacagcatggcctggaccaggctcagcgcgggtctgctctgcccgtcagggtccaacatgcccatcctgcaggcctggatgcccctggacgggacctggtctccctggctgccccctgggcctatggtttcagaaccagctggcgctgctgcagaaggaaccttgcggcccagatga

SEQ ID NO: 27368 - DNA, 1865 bp, Homo sapiens
gaccccgcgccagtccctgccgggtggaggaggcgcgccggcaaagccgcgtcctgatcaatggggcgggcggcttagcgcgcgcggccacctggtccgaggaggagcagtcccggggcccgccgcaggtcgggtggctcagccatggctcctcggggcgcagcggccggccggagcccgggaccctgcgcggggcgctgagctcccgagcgggcagagggcacgggcaggcggacgtcggggcgccctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccacggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaa

SEQ ID NO: 27369 - DNA, 518 bp, Homo sapiens
cctccacagcaacttccttgatccctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatc

SEQ ID NO: 27370 - DNA, 505 bp, Homo sapiens
tccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggca

SEQ ID NO: 27371 - DNA, 1305 bp, Homo sapiens
acagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattttccagaagacccgcacctatagaccaatctgcagagaaaacttctcttcttcaaaaaaaagtaaaagtgttctttcttaaaaaatgccctatttttcaacagtttggaaaataccatttgagcaagattctatacatctcaaataaaaagaatttaaaatgcacttccaggcaatcataatttgctagcataaatgatgagaaaccttggactatccaataggcaactgtagatcatgggtatgaaaccaccatggaggaagaattgcctcaaacaaaaaccaatagttttgtatttctttctaactatacatgtatattgttgagggttttctttagcatttattccctatgttaaattcttctttaatccttccctggtaaaaaaaaaaaaaaaaaaaaagttagaaa

SEQ ID NO: 27372 - DNA, 521 bp, Homo sapiens
gcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagcagc

SEQ ID NO: 27373 - DNA, 515 bp, Homo sapiens
acactttgtatggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatac

SEQ ID NO: 27374 - DNA, 2576 bp, Homo sapiens
aaatataaagtgattattttctcttggttctttgaaaaacctcgcttgtgctggggtttgtggctgaacccggtgacgtcagtgtggcagtgcggagtcaggcgcagcggctccctataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttccaatggacatgagtgatgattatgagacacagcagtggccagaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaa

SEQ ID NO: 27375 - DNA, 589 bp, Homo sapiens
gtaaggctgcttttctctttgatttattggaaagttccaaattgcatgctcttcttttaattcctagctgagaagaaaaagactgtttggcaagcttatgtcgataggataactgaatagcaacctgctgctcatcagccaatgaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttcca

SEQ ID NO: 27376 - DNA, 544 bp, Homo sapiens
gaaacggcccgagaagctcgcccggagaacggggaggaatatgctgtggagctcctctgccatataaacaaaaagagctgagaagaaaaagactgtttggcaagcttatgtcgataggataactgaatagcaacctgctgctcatcagccaatgaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctca

SEQ ID NO: 27377 - DNA, 1434 bp, Homo sapiens
atggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgaggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaa

SEQ ID NO: 27378 - DNA, 3310 bp, Homo sapiens
gttccattcccgggggattggagtagcgttggagtcaccgacgccatcccctcccgcctctggcgtgcatggagcatgcgcttccttcctcacttcctctgcaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttca

SEQ ID NO: 27379 - DNA, 2163 bp, Homo sapiens
gtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgac

SEQ ID NO: 27380 - DNA, 896 bp, Homo sapiens
agcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcag

SEQ ID NO: 27381 - DNA, 2466 bp, Homo sapiens
tcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 27382 - DNA, 2611 bp, Homo sapiens
aaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgagtggtgtgggcagggctgacagcaaatgggaggaggcaggcaaccgtttcctgcccttgccacgagatgtttttcaccactgcagttgggcatcctaggcccccaaaggtccagtacctttctccagggatctgggtggggggtcaggcagtgccaggcttctggtgacccctttgggagtataacctggatggctggcttcctggtgggcccaaaggacaggcttctctcaccccacccctcttcgccaggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagac

SEQ ID NO: 27383 - DNA, 1446 bp, Homo sapiens
agcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgaca

SEQ ID NO: 27384 - DNA, 1537 bp, Homo sapiens
ggaaggaagtcacatggaagaggggcggtagttggttgtgggcactgggttagaggtatcacgtgggggcactttcgtcttagcttttggacaagacgcaggcgcaacccacggctgctgcggggatccttgtggcccttccggtcggtggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 27385 - DNA, 2526 bp, Homo sapiens
ggtgggttgggccgggccggttgctaagacttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacaagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccccccacccctcccccgccgtgtgtggcccctcgccgcatcgttggggttttgttatgtgaaaatatcctggaaataaatacatgtttctgcacttaga

SEQ ID NO: 27386 - DNA, 2393 bp, Homo sapiens
ttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacaagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccccccacccctcccccgccgtgtgtggcccctcgccgcatcgttggggttttgttatgtgaaaatatcctggaaataaatacatgtttctgcacttag

SEQ ID NO: 27387 - DNA, 783 bp, Homo sapiens
actgcatctccggttctgtgctttgttgaacgcgtgagcttcgggcagcgctggggccgcttcagcgtgacctccaaggccactggcctggagttccactggctgctggtcccccatctgtggggcgccccggcggctgaggcgtggaccaggcagtgcatgtcgaggagtagcacccacagctgcgcggctgcgaaatgatccagagacacatccctgtctgcgggaggagccgtccataccagcggggatgtgtagtccaggctggcagttcaggatcacccggctggagtcattttaagatcatctgcggcttagccccagcaccatctgaggcagtactgtctgctagaaataactgtgagcacacaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcga

SEQ ID NO: 27388 - DNA, 3490 bp, Homo sapiens
ctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 27389 - DNA, 3407 bp, Homo sapiens
ctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 27390 - DNA, 3270 bp, Homo sapiens
tccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 27391 - DNA, 3503 bp, Homo sapiens
aggcaggggcggtgcgggggcgtgggcagcacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacct

SEQ ID NO: 27392 - DNA, 1881 bp, Homo sapiens
aggcaggggcggtgcgggggcgtgggcagcacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacct

SEQ ID NO: 27393 - DNA, 3248 bp, Homo sapiens
gcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggca

SEQ ID NO: 27394 - DNA, 2898 bp, Homo sapiens
cctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgttttagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaacc

SEQ ID NO: 27395 - DNA, 6307 bp, Homo sapiens
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaacggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaaga

SEQ ID NO: 27396 - DNA, 983 bp, Homo sapiens
aaagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggc

SEQ ID NO: 27397 - DNA, 6532 bp, Homo sapiens
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatg

SEQ ID NO: 27398 - DNA, 3444 bp, Homo sapiens
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaa

SEQ ID NO: 27399 - DNA, 267 bp, Homo sapiens
taccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctagccagcccagatgcacaagttccagtcttcctagccctctgcaaattgggcgtcgtctatttcttgcagtacatacgggaaacaaa

SEQ ID NO: 27400 - DNA, 7925 bp, Homo sapiens
gcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgtatgctgtaatataccacaaccaagcacctttccagacagactttttttaagctgaatgattcaattttttaatgttttttggaaattcagaagcttctgaaaacattcacttgtggcaatttgaatttatctttcattttaaactcctgaaattcagatttttacaagtccaatattgccctagggagaacatgaatttgctaagaaatgttatcttttaaatctctgatatctttgtcttgaagcagccttgatatgtagtaagcgtgattcactttagcctgattataatattatttatctaaagtttgtttatgcattgccttgtcccaggaattttttaagaggacttgcagagacacgtaccacacagtaacatttagactaaatatgctctgagtaaaggagaaatgaaaaaatattaaatcaagagtgaacatgtacacaaagtgcaattggaagtgggctacaaatttggcccccagcttcccagcaggcaactcaaagaggtaactgaggtaaaatgttccagctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctc

SEQ ID NO: 27401 - DNA, 1631 bp, Homo sapiens
gcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttggtaagtagactttagtggaaggctaataatattaacatcagaagaatttgtggtttatagcggccacaactttttcagctttcatgatccagatttgcttgtattaagaccaaatattcagttgaacttccttcaaattcttgttaatggatataacacatggaatctacatgtaaatgaaagttggtggagtccacaatttttctttaaaatgattagtttggctgattgcccctaaaaagagagatctgataaatggctctttttaaattttctctgagttggaattgtcagaatcattttttacattagattatcataattttaaaaatttttctttagtttttcaaaattttgtaaatggtggctatagaaaaacaacatgaaatattatacaatattttgcaacaatgccctaagaattgttaaaattcatggagttatttgtgcagaatgactccagagagctctactttctgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaa

SEQ ID NO: 27402 - DNA, 2224 bp, Homo sapiens
ctgagaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaa

SEQ ID NO: 27403 - DNA, 1892 bp, Homo sapiens
acagtccctgagaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaa

SEQ ID NO: 27404 - DNA, 3857 bp, Homo sapiens
ttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 27405 - DNA, 1518 bp, Homo sapiens
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcag

SEQ ID NO: 27406 - DNA, 3389 bp, Homo sapiens
aaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaatggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 27407 - DNA, 3576 bp, Homo sapiens
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 27408 - DNA, 3576 bp, Homo sapiens
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 27409 - DNA, 3497 bp, Homo sapiens
agctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttta

SEQ ID NO: 27410 - DNA, 3500 bp, Homo sapiens
agctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaatggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttta

SEQ ID NO: 27411 - DNA, 3686 bp, Homo sapiens
agctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttta

SEQ ID NO: 27412 - DNA, 3686 bp, Homo sapiens
agctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttta

SEQ ID NO: 27413 - DNA, 2436 bp, Homo sapiens
ggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 27414 - DNA, 3169 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27415 - DNA, 2496 bp, Homo sapiens
gagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattacctt

SEQ ID NO: 27416 - DNA, 2996 bp, Homo sapiens
tgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccacca

SEQ ID NO: 27417 - DNA, 2589 bp, Homo sapiens
tgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaaggtaagagcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27418 - DNA, 3171 bp, Homo sapiens
ggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27419 - DNA, 2611 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27420 - DNA, 2617 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaaggtaagagcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27421 - DNA, 2983 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27422 - DNA, 2983 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27423 - DNA, 2713 bp, Homo sapiens
cacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaatgccgtgttcctctattttatggtttgttcagtaaggtctgtatacatca

SEQ ID NO: 27424 - DNA, 3205 bp, Homo sapiens
gccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27425 - DNA, 2660 bp, Homo sapiens
ggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaaggtaagagcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaatgcc

SEQ ID NO: 27426 - DNA, 2371 bp, Homo sapiens
gtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaagacctgtccttttcctggtctcctcattcagcctccatatgatcctgttgtgaacatcaagtttcctgctacactggacttaactataatgcatttgctgcaggtttc

SEQ ID NO: 27427 - DNA, 3049 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 27428 - DNA, 1704 bp, Homo sapiens
aatcatccgagaaccttggagggtggacagtgccccttttacagatgagaaaactgaggcttgaaggggagaagcagctgcctctggcggcatggcttctggctgcaggatgcccatggagttcgtggtgaccctaggcctgtgtctcggcttcctttgctgaacttgaacaggaagatggcagtgggggccagtggtctagaaggagataagatggctggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccg

SEQ ID NO: 27429 - DNA, 2528 bp, Homo sapiens
acacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgtt

SEQ ID NO: 27430 - DNA, 2256 bp, Homo sapiens
aaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaa

SEQ ID NO: 27431 - DNA, 1752 bp, Homo sapiens
ataaattccctcccttcgctccttccccggaacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaga

SEQ ID NO: 27432 - DNA, 1928 bp, Homo sapiens
aacagcggcctctgacaccagcacagcaaacccgccgggatcaaagtgtaccagtcggcagcatgggtcatgtgtctccagctcttcccagcacaacctcaccctcctcagggctctgagggggcggagaggacaggccagagcgatgaggctggagtggggacctaggccagccgcactgccgtggcccgctgggatgtgtgctgcagaacgtgcggagggagccttcaccctccagagcgtggcccagccaatgcgccccattgcttccacagctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttc

SEQ ID NO: 27433 - DNA, 1530 bp, Homo sapiens
agcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttc

SEQ ID NO: 27434 - DNA, 2562 bp, Homo sapiens
cccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccga

SEQ ID NO: 27435 - DNA, 1083 bp, Homo sapiens
ggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcctactcaatgtgaagatgatgaagatgaagacctttatgatgatctgcttccacttaattaatacggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggtgagccctggtgagcttgaggagatgagttga

SEQ ID NO: 27436 - DNA, 1774 bp, Homo sapiens
atgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcagaggtgaagtgtcaagctgcaggttcaccattcccaaaggcgtcggcagcccccgcaccatcgacgttctgtccccgattggtctgtggggtggccaatccagcacctgccaccagccctccactggggcctgtcctgcttctgcgacagtaaccaggctcaggttttgccgtgcgaaggcagaggtactggttacacctcggcgtctgcaggctgctccctcactgtgcggcctctggtcaaaggccaccaccttcaagcaaccctccatgaaccacagctacattggttcccccatgtcccctgctgtcaccctctatccctgacactgctttatttcccctatctgatgtttctctgtagtgtgttcagatgtatgccccaccttctgcttccccgagagcaggggcttggccatgtcggcctcagtatccccagtacagagaaagggcttagcgcccaggaggccgggccttgggaagagtatgaatggattccctgttacttagaatattcaaaattatattattaacagtgataactgtggctacatttactagaa

SEQ ID NO: 27437 - DNA, 1186 bp, Homo sapiens
atgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgc

SEQ ID NO: 27438 - DNA, 1261 bp, Homo sapiens
gatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcagg

SEQ ID NO: 27439 - DNA, 2459 bp, Homo sapiens
ggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccg

SEQ ID NO: 27440 - DNA, 2762 bp, Homo sapiens
gtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaaccta

SEQ ID NO: 27441 - DNA, 3273 bp, Homo sapiens
ggccgcacgccgccacccagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaaccta

SEQ ID NO: 27442 - DNA, 2384 bp, Homo sapiens
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaatttttt

SEQ ID NO: 27443 - DNA, 660 bp, Homo sapiens
cgggttccttgctcccctccccggccgcctccgacgcgggcgtcctggagagcgcgccccattgtgcggggccggcggggaggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaa

SEQ ID NO: 27444 - DNA, 383 bp, Homo sapiens
cggagctgcttttcagccctaggggcgtgctcaagaatcccccgttactctgatcaaaggacttgctaagtttagaaataaagcgctttacaaatcaaatgcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgt

SEQ ID NO: 27445 - DNA, 1569 bp, Homo sapiens
cgggaggaggcggagggcgcaaagcgagccggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctc

SEQ ID NO: 27446 - DNA, 2689 bp, Homo sapiens
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcagatgtgcagtaatttattagaggaaacataaatggaggataaacgggagatggagcaagcgtaggtagagagagccatcagacagcagtgcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaatttttt

SEQ ID NO: 27447 - DNA, 2089 bp, Homo sapiens
aggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggctgacgggcttctccggcatgaagggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttg

SEQ ID NO: 27448 - DNA, 2235 bp, Homo sapiens
gtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 27449 - DNA, 1347 bp, Homo sapiens
atggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtga

SEQ ID NO: 27450 - DNA, 2094 bp, Homo sapiens
aaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttg

SEQ ID NO: 27451 - DNA, 4230 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccaaagctgtcactgttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaac

SEQ ID NO: 27452 - DNA, 4332 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcttgttctgtcacccagactggagtgcagtggtgcagtcacagctcactgcagcctcaacttccctggctcaattgatcctcctgcctcagcctcctgaggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaac

SEQ ID NO: 27453 - DNA, 4212 bp, Homo sapiens
gcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 27454 - DNA, 2204 bp, Homo sapiens
acagacaggcaggtgcaggagacggggtgagcgcttttgggctctagccccatggcagcatctaggggtgtgttacaattaatgctcttttagcagttgctgttcgcggatggctaagtgttaaaccagctcagtggagagtcagggtggcagccttttacgccctgtcctcttggtacccgggtctttgtctagcatccaggaagaatcaggtcctacagacttgaaggatggtgaatacagagattttattgaatgatggaggaggctttcagcaggatggatggggagctggaaagcggatggagtgagaagataatcttcccctggggtttggccatcccatggctgatctctctgacagtccccagccgaactcctctcgatgttcagacactctttctcctctctcctctgccacactgctctgctgctcttctgctcatggagcctgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatcttt

SEQ ID NO: 27455 - DNA, 787 bp, Homo sapiens
tgtggagctgccagagtaaagcaaagagaaaggaagcaggcccgttggaagtggttgtctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatc

SEQ ID NO: 27456 - DNA, 1853 bp, Homo sapiens
gtggagctgccagagtaaagcaaagagaaaggaagcaggcccgttggaagtggttgtttaagttcttatcaagatatcatatataggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatc

SEQ ID NO: 27457 - DNA, 1047 bp, Homo sapiens
caggagcatgacgagggagagaggtcatcgaggctggggtgagacatctgacttaccgtcaggagccacgtcagtgcctcataaaatccaatctccattcaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaa

SEQ ID NO: 27458 - DNA, 2243 bp, Homo sapiens
gtcaaaatgttttccccatattatgcatggcagcacttgctactttcttttaagttgataacaatcagctcaggggtttgctctgcttgcaaggtcactgcaagaatgaacattgaactttggactatacctgaggggtgaggtaaacaacaggactataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctga

SEQ ID NO: 27459 - DNA, 888 bp, Homo sapiens
gggctggcgggtcgcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaa

SEQ ID NO: 27460 - DNA, 881 bp, Homo sapiens
gcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgctgcggggccggaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaactg

SEQ ID NO: 27461 - DNA, 1423 bp, Homo sapiens
cagccctgaggaggggcggggcctcccggaggcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagatgtactgtctttttttttgtttt

SEQ ID NO: 27462 - DNA, 839 bp, Homo sapiens
gcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgagaggccacaggggtgggggagggacgggggcggccagggagagcagagagccagtcccaccttcctccctctgcttgccccacagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaacaccatctgccagccccagtaagggccttcactgtggctgtatcatggccagaagctcacccagctgccttgtgatctttccaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacag

SEQ ID NO: 27463 - DNA, 6476 bp, Homo sapiens
cagtttggcaagtcagtgcaagaggctgacttctgagaggcttccaggagcccgaagagaggacctccacgggagaagggagtgcgtgtgctcggttttgtttttttctctcttttttttttttttttctgaatgaacagctttgcccaagtgactgaaaaatacagcttcttcctgaatctaccggcgtagttgctgaagagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatttctgtaatacaggaatgactatgaaggtgttataataaattattctacatactcatttgactggataaactttacataaaattaactaattttttaaataaatgcattgcttaatggtttctcattatgtttatcaaaaaacaactgtagctgttattttcagtacttggctgcttttctgtgaaaattattattttacttttggaagacaagattattagaatattgaagaaaaattggagacttataatcatggtaaatataaaactaaatatgttttaatatttctgaatttttcttttccatcacaatgtaagatatgcagaatacaagatactttggcattctcatgtgaactttctgtactctttaaggattattttattagtgttgtttaagccatgagtgttaagtagcaggtgtgttgtgagtgctgtaacccatgaaaggaaaaatgtcattctgaggcttgtgcccttcgtaaaatattcattaaagtacattcacactatttttgctttataacacagtctttaattttcactcactgtggaaataaaaactaaggtaacttctcagaaagatatcaaatctcagaaagaatgtcaaatcagatgaagttatagttaggattctaactactgtaaaagatttttgcttccctcttgtggtaaaaaaaattatattctcacacatttcttttttctctacagacggatatctgtttaggaaagatttgaaagcagattatcagtaggtacatggatacatcaagttcatttgcagaaacaaataactgaaataaaaaacatgttaatccttgtatcatactttaatatgaaagtattgtttatagataatttatctcacaagtcaaaaatgaagattttgcagcactgaaaatctattaaagctccaaattttaagtttctaaataatcttcgctgaaatctaaaatatactataacaaccgtgttttatttgtgaaaaaaatattaaagtgatttgctctcaaatatcaaattttcttctctcttttatattaagagacagaaaattgtttcatgagttcacttaactactgagatattcagagcatttttacctctctcttaaatgttataaaaaacaattgtatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaaagcctgctcaatttggagaaatagaaccacaaacacagatcacaggggccttacaaagtttatgtctgaacaaataagtcaattaagtacactttattgaaaattgccttccattaacacacaagaaagaaagcaggattttctcctgtatctgaattttaaaattaaaaaggcagataagacataaatagttatcattttaattgcaataacacagacaagtagttaatgatgataacaatggtgtaacttgtaaactaaatatttggtaactgaagcaataggcagaggaaaatagcttttctatgacacaagtcataagaagtccatatactgaagagcgtttgattaaaataaagtgactattaaccagaaaagaaacattttacataaaatgctaaaatttattataggaaaataaatcaaacccaaagaaagtttattcaatgctaatttgaaagaaaattgataagaaaactttgagggcccaagtccacaatttggtgagaccactaaattttacatataattatacacacacatatgtacatatatatgtatataatcttgcttcccgcctgtttatggcagtactgaagagaaatgggaaagaagagggagggagagagaaagacgaagggagagagaaagcagtttccaaggatatgtttcatgtcccaccattttctcagtttctccctctctctcccaacacacacacacacacacccctcacatactataaaataaatcttcactgccctatcaaaatacaaataaatcaatctatgctgttctgtccttcttgagaatctaaaacataccacaaaaatacatccccagtcttttgttctgtctgaggttagaattaattcaaattcagaatctgttgtgagaaatgcccaggctttaaaaattaaaaatggatggatcttctctgaactcagggagggcacatacttagatacctacaagacttggaggaattaagagttcacccttcatctcaccaaattttccccatttttctctttcttgtagaaggagagaaaccatgctctctagcaacattgagcaaaaatcataaccactcatctaatttctaagaggcacctccatcgagggccggtctcctgcttctttagacctcttctatctttgttacaggagaggacctgtggatagacttagttttgacataaaacaatgcccattcacctcctccttcagcacaacgtcacccattgggcaagagatccagatttgttaacaaaaaagattttacttcgtgattccacgtctataattctatattgctaattttttcttttgtgtgaattactgaatatttcagagcaaagctatcaacttggagaaacagggattaaaaataaggataaacactaataagagctctagaaaaaagggaacagaaagtctgcctgtttagtaagtggcaattccatacatattttagagttttttctatctaaaattagttaaatacttagaatgtttgtaatgagtgttcgatatttgctataggttttagggttttgtaaatcttcatagtaattataaacatttgtaaaatttgtaaaatactataagtcattttgagtgttggtgttaagcatgaaacaaacagcagctgttgtccttaaaaatgaattgacctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctc

SEQ ID NO: 27464 - DNA, 2414 bp, Homo sapiens
aaactaaacagtgtcctataggcagctatcagctcagcatgtgttgtttacttggaaagtgaaagaaagtctcccactttgccttcccttagatgaacagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatt

SEQ ID NO: 27465 - DNA, 2922 bp, Homo sapiens
ctagaaacagcaagtacgctgctcaaccctgcctgaactttcctgtaaacagccactgacagactgcatccctgctgggtggatcctgcgactcctagagggaatggcacttcttgtttttaattagcaaggtgaaaggtgaattaaaactagcagtttggcaagtcagtgcaagaggctgacttctgagaggcttccaggagcccgaagagaggacctccacgggagaagggagtgcgtgtgctcggttttgtttttttctctcttttttttttttttttctgaatgaacagctttgcccaagtgactgaaaaatacagcttcttcctgaatctaccggcgtagttgctgaagagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcagcattaccgcctgcccaggcacacgctggactcctga

SEQ ID NO: 27466 - DNA, 3137 bp, Homo sapiens
gggctgaggcactgagagaccggaaagcctggcattccagagggagggaaacgcagcggcatccccaggctccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 27467 - DNA, 3249 bp, Homo sapiens
aggatgatgaaagtgagaccgtcttagggcccttccagatagggaaccttctctgccccaatgccccacccctgccaccaatacacacgcttctgctgcctggggctctcctattggtcctcggggggatgtggtaagaactgctcacccagaaagtgcccgggtgcctgtttccccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatgat

SEQ ID NO: 27468 - DNA, 3135 bp, Homo sapiens
agtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 27469 - DNA, 2981 bp, Homo sapiens
agctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 27470 - DNA, 3300 bp, Homo sapiens
ccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 27471 - DNA, 3130 bp, Homo sapiens
ggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 27472 - DNA, 975 bp, Homo sapiens
cccctgaacccaggtggtgacatgtgcacggtggtgcctgctgaaggtgggcaagggagctgagcagggaccgggggctactgtacctccttttcacctcctcccgcatctggagcccctcctcctccacatgtgcgaatccaggagccacagaaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccaca

SEQ ID NO: 27473 - DNA, 1057 bp, Homo sapiens
gtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctac

SEQ ID NO: 27474 - DNA, 897 bp, Homo sapiens
gcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaa

SEQ ID NO: 27475 - DNA, 3135 bp, Homo sapiens
agtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatgggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 27476 - DNA, 11762 bp, Homo sapiens
acttgccgggaaggcggcgccggtggcggctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacattttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaataccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcctcggctggattttcatcatcagatatttcaactcatctcatcagtttcttgtaagaaaaaaacattttcactttgtagcacattttagttatttttgagtcttcttccctaatagtttgtaagcttaaagggacattttattttccctggtaaagaggattctaatatttcaagaatgtttcactggaattgatgggaaatggtttctaaatggcatcgaagctggtctttaatgagtcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccttcctgccttcttttcttctttcctttcttctttctttaattcttcctttcttcctattttcttggtacaagtggaacaaaaaccaacacatagttttaagctacacctttctgcacctgatgtaaaatgacattaatcactatttaacttctaaaattatttctgaatacagttggagataggctggttttcatgaggaagctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagtccgttcatgtcatgtggtttgggatgaaccaggggtctggccccatcgggtcacaggtgatggcaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaaaaaaaagaacaaagtcttagcggggggtctctatgtccccaagtggctctctaaggggatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatggggttttcttgtgtgtgtcattgggggtaactccattgacctcagcatttctatctcaagagatggctctggaacacagaaccagaggcaacaggtactaatggttgataaaattaacagcgactgcataaccattttccacatggcagggctgtgcttaagccccacacctccaataatcaatttctatgacggtactaataaccttaactatatgcaaattcttcaccacttatgatatggtacaaactggagtttacagatggccttggccttgcctagcccatttgttcatcctaacttcttcatcacttcctgatgcacttggggaagcatgttgacacaacgttaccaatatttgattacctatggttatctgcaattacctacgcttatcttatcagaccctagatgccatttgagccccttacttctttgggcagtgggtgaaatgggagaacatagagaaatgttcactttgacctaagaaacgcataaaagggaatgccatgcacaatgtaagataaaatgtttggggacaggggatcatcgtgaaatttatttctgctattctgccctattgaggtcattaattataatggatttaaagatttttttttaaactctacaaacactaagccaaggaattcaggttatctgctatgttaacctaataaagcaaaggaaaataagttgctttaatccttgcttgttaacctaataaagcaaaggaaaatatgttgctttaatccttgcttcttttctcttttggtaatagaaaaggtaaataagatgtaatgttgaactgctggtgatgatttctaaaacgactctttaaatactcctttcctatggacttatattaaagatgcattgtacacattgttttagcagatagatcaaagatatactcagtggtcatctgttgcattatcagaaatttgatacatgttacagaagcatgaggaagggaatcctatccacttttgaaaatagagttcacattgcaagcgacatagggcattatcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagaggaggtagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatttatcatttcatgtggatattattggtctaattagaaggagaagattgattggatttactttaaagaaaattattctcctatgtctctttgaactcaggaatagaaaatgaccaagaagcacatcatcttcagatgtgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttgaaacaaagcacagtatgaatctttaacccaagcacttagtttcaccactgagattctacatcatctgcaagaaaatgcacaaacttttggtccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttaggggacaattta

SEQ ID NO: 27477 - DNA, 935 bp, Homo sapiens
attcatacacacacacgacctgggatatgactagaaaaatatgctgctctaagccctccaagctctcctctatctccacaaagtgtaaccttaaagcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgca

SEQ ID NO: 27478 - DNA, 3377 bp, Homo sapiens
cagtctcggctgattgccgctgtcgctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattta

SEQ ID NO: 27479 - DNA, 3228 bp, Homo sapiens
agtgcgtgcgcgcagctctgcgggtcccgggctgtccccgcgctgtccccgcgtggagcgtgtgggtttgggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattt

SEQ ID NO: 27480 - DNA, 3333 bp, Homo sapiens
agtctcggctgattgccgctgtcgctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattt

SEQ ID NO: 27481 - DNA, 1266 bp, Homo sapiens
aaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataa

SEQ ID NO: 27482 - DNA, 1662 bp, Homo sapiens
aaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcatctg

SEQ ID NO: 27483 - DNA, 2051 bp, Homo sapiens
gacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgcttta

SEQ ID NO: 27484 - DNA, 11100 bp, Homo sapiens
cttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatcca

SEQ ID NO: 27485 - DNA, 11103 bp, Homo sapiens
cttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgcaacttcttcctaggagcttttgtgtacacgtgaaccattcgccttttttcagcccagaacccaagtatctacactgggctctcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 27486 - DNA, 10917 bp, Homo sapiens
cttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 27487 - DNA, 5730 bp, Homo sapiens
gtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgcaacttcttcctaggagcttttgtgtacacgtgaaccattcgccttttttcagcccagaacccaagtatctacactgggctctcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatcca

SEQ ID NO: 27488 - DNA, 5490 bp, Homo sapiens
aaatacgccaacttcctcctggagcgccatctgagaaggtctgcgcatgtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtcactgacagta

SEQ ID NO: 27489 - DNA, 5496 bp, Homo sapiens
attctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtca

SEQ ID NO: 27490 - DNA, 1480 bp, Homo sapiens
ggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttc

SEQ ID NO: 27491 - DNA, 1592 bp, Homo sapiens
ccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgccctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggccacg

SEQ ID NO: 27492 - DNA, 1589 bp, Homo sapiens
ccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgccctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggcc

SEQ ID NO: 27493 - DNA, 1379 bp, Homo sapiens
gccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatactaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaa

SEQ ID NO: 27494 - DNA, 3117 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagacaatgaaacttattagtctgtgtcagattctgagcaatcatagagtcatctaagttgtaaataaaaccttgcatagc

SEQ ID NO: 27495 - DNA, 3091 bp, Homo sapiens
gtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaaggaaccaggctgtcgattcgaactcctgtgcattgatgtcagagcttgtgaaaccaatggtggacgtaaagacgcagagaaagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaa

SEQ ID NO: 27496 - DNA, 3071 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaa

SEQ ID NO: 27497 - DNA, 2719 bp, Homo sapiens
cccgttgcttctgccctccggccttcccgccgccgtcgccgggaccagccgctcggggccgggctgatacagccgcttcaccgtgcccctgcccgcgaccatggcctcctccgaggtggcgcggcacctgaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttact

SEQ ID NO: 27498 - DNA, 1605 bp, Homo sapiens
ccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaa

SEQ ID NO: 27499 - DNA, 1782 bp, Homo sapiens
gccctccggccttcccgccgccgtcgccgggaccagccgctcggggccgggctgatacagccgcttcaccgtgcccctgcccgcgaccatggcctcctccgaggtggcgcggcacctgtgacgtctctccagtgaccttagtttgagtcacttggactcagaatcatgaagtcagcttcttgcagcctcaccttttctgctgtccttgcatttacatctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaaggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttgggctccaattttttgtaaaacagaagttccagagcacagaaggtcatcatcacaagcaaactttattaaaaaaaaactagaagtgtgctt

SEQ ID NO: 27500 - DNA, 1393 bp, Homo sapiens
agtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatagtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagct

SEQ ID NO: 27501 - DNA, 5593 bp, Homo sapiens
cgggtggccatgttgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatt

SEQ ID NO: 27502 - DNA, 2615 bp, Homo sapiens
ggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttggaagagctgctagtggccactagtttcctcaaaattcaatatgatgaattgttttattgtgaaatgggatccaaatgcctatccagttgacacctctgccaacctcaagccaaacctaaacccattcataaaaggttttttttaaatagggtcttaatgtcatgtgccaaagggtcagattctgctcttgagttggtcacttcctgtgatactccagtagcagctgcctgaaaccagtgggagatttaggcctcccttgacattctcctgtgatttgaagctctcctttgaatcatcataaagcctagttttatgtcaatgctatcggttttgacaggaagcacgatggtaagaataccactaacgaaaacctttgtggtgtctcaatgacaaatatgcagatgccaccctcctttgtctaatgtacggtgctttagggcagctatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatga

SEQ ID NO: 27503 - DNA, 5422 bp, Homo sapiens
atggaggagaggaaaccagctcatgtgctgagaagttttaaatatgctgcatttatgaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatt

SEQ ID NO: 27504 - DNA, 1294 bp, Homo sapiens
ccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaac

SEQ ID NO: 27505 - DNA, 1386 bp, Homo sapiens
cttgggcccctggttctacttggggattattgtattattaggctggggtcattgtggggattagaagggtaacagctcctgctcctgctgcagagaagcctccaggtgggggtcacagcaagtgcagatggagctcagattcttcggttaactgtcaccctctcccctcccccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaaggcattttgtaaatgacttctttgagctatccacaaataaaaaggctgggtgtca

SEQ ID NO: 27506 - DNA, 3785 bp, Homo sapiens
acagtgaatatttatttggtccacaactggggacagtagaaaggacaccagcttggaatcagttcggacctgtgtctgctgcacagctgaatccctgggaaactcttttagtgtagcatggcagaaagaacaatggctatgcccacacaaatacctgctgatggagatacacaaaaagaaaataatattcgttgtttaactacgattggacattttggttttgaatgtttgcccaatcagttggtgagcagatctatccgacaaggattcacttttaatattctctgtgtgggggagactggaattggaaaatcgacactgatagacacattgtttaatactaacttgaaagataacaaatcctcacatttttactcaaatgttggacttcaaattcagacatatgaacttcaggaaagcaatgttcagttgaaattgactgttgtggagacagtagggtatggtgatcaaatagacaaagaagccagctaccaaccaatagttgactacatagatgcccaatttgaggcctatcttcaagaagaactgaagattaaacgttccttgtttgagtaccatgattctcgcgtccacgtgtgtctttacttcatttcacctacaggacattccctgaagtctcttgatctattaacaatgaagaaccttgacagtaaggtgaatattataccactgattgccaaagcagacactatttctaaaaatgatttacagacgtttaagaataagataatgagtgaattgattagcaatggcatccagatatatcagctcccaacagatgaagaaactgctgctcaagcgaactcctcagttagtgggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaataatagtttctcttactattctgagagccctatcattctacatcgcaacttcctgtgagattgtctttgtagcatttaactctgaagttctcattttaaaaattggcttgcttattgtatattttccccaactaaagtgtgaactcctagcggggtgtggtggctcatgcctgtaatcccagcactttgggaggctgaggcgggtggaccacctgaggtcaggagttcaaaaccagcctgaccaaaatgatgaaaccctgcctctactaaaaatacaaaaattagctgggtttggtggccggtacctgtaatcccagccacttgggaggctgaggcaggagaatcacttgaaccccggaggtggaggttgcagtgagccaagatctcaccattgtactccagcctgggtgacaagagcaaaactccgcctcaaaaaaaaaaaaaaaaaaaaaagtatgaactcccagaaggcagatcctgtgtccctcttttcagattctgtatcttggcacttaggacgtacactaacacaaatatgactttcaatcaatatttgccaaaatgaaaaaacaaaagaaacacgtagcatcatgtaaaaggagctggttaggtggagaaatttatttaccatagtcctgcttttggatccagtagtgacttttaacttttatatccaaatagaagctggaggctttgttggggactcataggcataaaatgttaagttatacaaatctaattaataggcctattttcctttttaagttctactactgataatttcttgacagtttttatgataaaaggttggaatttgataagaactcccatgcttttgtgtcagacttaaaactgatattagaataaagaattcaaaagctagagaaagagttgcatttgaatgataatattatgtgttacagatttggggtatatgccaaagttatcaaagttgtagaaaataaggccaggtgtggtggctcacacctgtaatcccagcactttgggaggccgaggtgggcggatcacttgcggtcaggagcttgagaacagcccggccaacatgacgaaaccccatctctactaataatacaaaagttagccgggtgtggtgttgtgcacctgtagtccctgctactcggaaagctgaggcaggagaatcgcttgtagccaggaggcagaggttgtagtgagcagagattgcgccactgcactccagcctgggtgacagagcgctgagtcaccacacctggtataagccactgtgcctgacccacaatgacttttatacatattgttaaatcatcttacagattttataatttgggggaagaaaaattttactaaatgatcttttaatggaaactctacaagaaccagaatctttgctttgttcacttatgtatccattcctaggcctagaaaaatgtctgacgcatagcagcaattattcattgaataaatggacccagcaatagtacattagctatgccatatgcatacattaaaaatgtagattattgactttcaaaagataattaatgtaacttcttactgcttctgaacatgtttgtgagttatattgctgagggacctttatcttctcattctttcatcttaatccaatgttattaaaactgaaactgaaatcaccaatattattccatatttaaaaataacatctaccttataaaaattatcattgtgctgcatttgagaatagactttttaggtaataatggtataatccatagggtttttgagggcacagaaggattcatgctaacagaacattttattttctattttccaagagctataaaacatgatattatatgatactataaggcatatttttattttccataattttttctaaaaaaaattagtgttggttttccatataacttttaactttataagtaaatatttgtctctttcagctccagtttcatgtgaaatagagtttccagatttatgtagcatggaaagttttaatacgtcagttactgatttttgccagtcattttctcaattatttacttcttttatctttagttgattttttttgtagtgacaagttttgtttctattctcatttccttttgtgtatattctatgtagatttcgtttttggttactatgaaaattacatataacatcctggagttataacattctgatttgaatttatttcaacttaacttcaatcacataccaaaattctactgctatataggtctactctttttaggttattgatgtaacaaattgtatctttattcattgtacaccacctaacagatttataattacattttatgcatttgtcttttaaatcctgtagaaaataaaaagcggagttacaaacc

SEQ ID NO: 27507 - DNA, 3613 bp, Homo sapiens
gatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 27508 - DNA, 3315 bp, Homo sapiens
gacgcaatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 27509 - DNA, 3278 bp, Homo sapiens
atgccgtggataagcgaggggagagcgactaggccctgtctgcgggtaccttcggcgaggagaggcgacgaaggtctgcaccagcgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 27510 - DNA, 3701 bp, Homo sapiens
acctcgggccccacaccagaaggagaaagctaggggccgcgccagctccgccctcccccgcggggcggcgggccccagcccgggcacaggaaggccacgtccccggggagggacgcccgactcgatggtctgcgcagggcccgtcggccccacgtgacgtgcgcgcagccaatcccagagaggccccccgatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 27511 - DNA, 3333 bp, Homo sapiens
gctgggcgggtccgcggcgcggtcggtcggcgcctgttctcgggctgtttggcggaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 27512 - DNA, 539 bp, Homo sapiens
gggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgact

SEQ ID NO: 27513 - DNA, 644 bp, Homo sapiens
agtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaat

SEQ ID NO: 27514 - DNA, 724 bp, Homo sapiens
ccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacct

SEQ ID NO: 27515 - DNA, 775 bp, Homo sapiens
cgggctgtgagcggaccgcgagcgctgggcgggtccgcggcgcggtcggtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaaggtctgcaccagcgagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgtt

SEQ ID NO: 27516 - DNA, 574 bp, Homo sapiens
gtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaaggtctgcaccagcgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcat

SEQ ID NO: 27517 - DNA, 372 bp, Homo sapiens
gcgcggtcggtcggcgcctgttctcgggctgtttggcggcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagc

SEQ ID NO: 27518 - DNA, 575 bp, Homo sapiens
agtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcag

SEQ ID NO: 27519 - DNA, 599 bp, Homo sapiens
tgcgtatacatacatactatgtatgtgcgtttatgtgtgtctgtgtgttttttttttaacagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 27520 - DNA, 801 bp, Homo sapiens
agagatgattgcaaggatgcaggcgcagatgcagatgcagatgcagggcggggatggcgatggcggggctctcgggcaccacgtgtaaggtgatgtgcacatatcaagaagtcagagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgct

SEQ ID NO: 27521 - DNA, 991 bp, Homo sapiens
agcccgcgccccgctcagccttgcagccccgcgcccggagcatctccctggaggaacggagacaaaggaggattcatgtccaaaggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaat

SEQ ID NO: 27522 - DNA, 2258 bp, Homo sapiens
gggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 27523 - DNA, 4649 bp, Homo sapiens
tgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatgctctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 27524 - DNA, 2586 bp, Homo sapiens
ggcggcggcaacggtgcgcgcggacaggggcggcgcggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 27525 - DNA, 1866 bp, Homo sapiens
cggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaaggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagc

SEQ ID NO: 27526 - DNA, 876 bp, Homo sapiens
actagacccagaaccttcgaggggagggatggttgtcctcacccctgtgaggcaatatgctgtccattagtatccactgaatgcgtgaaatttttttctaatgggcaaactgaggctcagagaagttcctgtctggctcaaggttattggttcatcattctggagcagggcctggaacccgggcccctgactcggctctacaggcacccgcgcaacaccccagcccccgcgtgactcacgcgcgctcacggccgcccgcagctgccactggtcccctgcgcccctccgcccgtccccgccgcagcccagtggggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagt

SEQ ID NO: 27527 - DNA, 1588 bp, Homo sapiens
cgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattg

SEQ ID NO: 27528 - DNA, 3173 bp, Homo sapiens
cgggagcggggcctgcccggactgcgacgccgccacagcttggggccagttcgcccagtcagggggatggctcggtcggcctcgggggtcgacgatcccccgggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggt

SEQ ID NO: 27529 - DNA, 2241 bp, Homo sapiens
tggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggagggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 27530 - DNA, 1336 bp, Homo sapiens
acaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggactt

SEQ ID NO: 27531 - DNA, 2070 bp, Homo sapiens
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 27532 - DNA, 4113 bp, Homo sapiens
gttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgc

SEQ ID NO: 27533 - DNA, 2693 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctgg

SEQ ID NO: 27534 - DNA, 1576 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaactttttttaatcttgtcttcagcagctgcac

SEQ ID NO: 27535 - DNA, 4652 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaatttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaa

SEQ ID NO: 27536 - DNA, 2609 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgctttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaa

SEQ ID NO: 27537 - DNA, 4694 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagcttt

SEQ ID NO: 27538 - DNA, 1859 bp, Homo sapiens
gcattgcccaagagccgcagtgagcgccaccgcctccctcgctgcagctgcggccccacggctggggcgttgccgaatgaatggccgtaggagccgccgagccctccgggtccctggcaccctggccttgccgcgcccctgcgcacggctgcccgttgtgacccgggaccgcacaggcaaagaggcgcggggctggggttagcctggggcagaaggcgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacc

SEQ ID NO: 27539 - DNA, 1720 bp, Homo sapiens
agtagctcccgttgcggcggcacccgtggcagccctggcggacgcaggagcgatggcagcgaccgatatagctcgccaggtgtttggcaggaggaggcttctgctgctgggatttgaaaccgtgggtttctctgccgcctgcacagaggaaggaggccacatgctcaggaggggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaa

SEQ ID NO: 27540 - DNA, 1617 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgctttttttaatcttgtcttcagcagct

SEQ ID NO: 27541 - DNA, 1066 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcagggctcctcccaagtc

SEQ ID NO: 27542 - DNA, 2889 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaacagatcagatataggagcacaccagccgggcatgagcctctccagctctaaggtgatgatgaccaaggccagtgtggagcccttgaactgcagcagctggtggcccgccatacagtgctgcagctgcctggtcagggatgcgacgtggagggaaggattcctctgaggcagcagctccaacacatggggccagctcaggaccaccagggcatggaactggagaccatggtttttaatgttagaacagaaaacgccatacttttcctatatcaatgatcaaaagtgcaaacaatttaaatttccatcagggaacatcaaatgttgcccaacccttttcattcctatccatggctccgtaaggggcttgaggcttaatgcccatcctgtggccaagctgagcttccactccgggaccaaaaaaaaaaaaaagtctgctttgtgacatcatcgttatgagcggaaagtacctagatgacaatgtttccattctgaaaaatagaaacatactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacattgcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttaatttaatgtcctttagaagtgggagtctggtggaactgtgttggatttaagataccttttcactcttccgtatgtcatgagccttgtgcgtcacctcactgtggtgcatgtgcaagggcgtgtgcacgcctgtgctttgccatcccatgttgtaaacagctgttccaaaggcacaaacgagtttagggtagactctgtaaacacctccttactcactatagtcaagaagtccagcggcgtcccaatatagaggtcccagtgcagtctgtccagaatagccagctccatcctcagcagctcattcggggaatagtcagagccatagtgctttgtgaagtcttttacttgtggaataaactgtaaaaagaaaataaagaggccaaagccctacatcatg

SEQ ID NO: 27543 - DNA, 4270 bp, Homo sapiens
tgctcgttggttgcacaaggagccgaaggctggtcccttgcccgggaaggccgcctggccggacgcgcgggtcccgccggggttcccgccttagctccggccggagcatcaggtggggcccaagacacccgcagactaggctgccgcggcctctcccggatccgacgggtctcccgcagcttgtccacactctgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttg

SEQ ID NO: 27544 - DNA, 4390 bp, Homo sapiens
gcagctggcacctcccgcctcgccgcggagacccccggccgtccaagcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttg

SEQ ID NO: 27545 - DNA, 1726 bp, Homo sapiens
ggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgt

SEQ ID NO: 27546 - DNA, 4453 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27547 - DNA, 1470 bp, Homo sapiens
actccagacggcgggccgccccctcttcccgccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgctgcccctcctggagcagaaagtgcctttatctcagccatccgcagactgcttggccagatgcggggacaggctggaatga

SEQ ID NO: 27548 - DNA, 3982 bp, Homo sapiens
ccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27549 - DNA, 3821 bp, Homo sapiens
actccagacggcgggccgccccctcttcccgccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27550 - DNA, 3635 bp, Homo sapiens
agttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27551 - DNA, 3935 bp, Homo sapiens
gtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27552 - DNA, 3230 bp, Homo sapiens
acttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27553 - DNA, 3996 bp, Homo sapiens
actgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27554 - DNA, 3023 bp, Homo sapiens
atggctggtgctggatgcacagggacgtggtcctggctctgggggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27555 - DNA, 1848 bp, Homo sapiens
tatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtcttgtggggttctcagtgccggaccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 27556 - DNA, 2253 bp, Homo sapiens
gttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaat

SEQ ID NO: 27557 - DNA, 2913 bp, Homo sapiens
gcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 27558 - DNA, 2986 bp, Homo sapiens
agagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaa

SEQ ID NO: 27559 - DNA, 2000 bp, Homo sapiens
gccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaacc

SEQ ID NO: 27560 - DNA, 628 bp, Homo sapiens
agtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcag

SEQ ID NO: 27561 - DNA, 1506 bp, Homo sapiens
acggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagc

SEQ ID NO: 27562 - DNA, 842 bp, Homo sapiens
tccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgg

SEQ ID NO: 27563 - DNA, 1208 bp, Homo sapiens
gaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggttaa

SEQ ID NO: 27564 - DNA, 1606 bp, Homo sapiens
ggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatatttatgaaacaaa

SEQ ID NO: 27565 - DNA, 1281 bp, Homo sapiens
accattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccaggtgagcagctggggtgcctccctcgggtgtccagcaagcactggggagtcccccttagggctggctttgagatagatcctgatgtcagcctgtttcacagatgagacaatggaggctttgatcgcttgcccagggccacgtccagtgagtggtacagcttggactcaaacccaagtctgtgtgactccaacatgtcacacttcctcacgtgaaaagcctcatatgaggctgggcacagtgacttgtgcctgtaatcccagcactttggaaggccgaggggggtggatcacctaaggtcaggaattcgaggccagcctggtcaacatagtgaaaccccatctctactaaaaatacaaaaattagccgggtgtggtggtgggcacctgtagtcccagctactcggtaggctgaggctggagaattgcttgaacccgggaggcagagattgcagtgagctgagatcgcaccactgcactccagcctgggcaacagagcaagactccgtct

SEQ ID NO: 27566 - DNA, 2464 bp, Homo sapiens
ggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 27567 - DNA, 378 bp, Homo sapiens
atgagatatttgctccaagttgcacagctggtttggttgactgtagattccagaggcattggtggaacacttgatcatgctggcttcagcatctgcattttcactgtcccacccctaagcttctttggcctctgtgaagcacagactttcggtctgagtggatctaagtctcctgctcttcacagatactatggcgggactgagtttattgatgaactggagaccctctgtcagaagcgagccctgcaggcctataagctggacccacagtgctggggggtcaacgtccctactcaggtgcttgtctcatccatatggcctggtgcagcctcttcatgtgcatcccccagggccgacatgcaccaagaagagtcctaa

SEQ ID NO: 27568 - DNA, 2136 bp, Homo sapiens
ggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttctt

SEQ ID NO: 27569 - DNA, 1656 bp, Homo sapiens
cgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatt

SEQ ID NO: 27570 - DNA, 570 bp, Homo sapiens
ctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagaggtatgtgaatatcttcaaaggcctggttctgacacagtcatagggagtactcagtcagcctaggacctaaacaatttggaaatttcagaaaacaataagcttcccagctgtaggatttctgttccacgcctgctctctgacagaactcttttattcccagca

SEQ ID NO: 27571 - DNA, 2652 bp, Homo sapiens
ttttttttcagatggagtctcgctctgttgcccaggctggagtgctggagtgcagtggcacaatctcggctcactgcaagctccacctcccgggttcacgccattctcctgcctcagcctcccaagtagctgggattacaggcgcccgccaccatatctggctaattttttgcatttttagtagagacggggtttcaccgtgttagccaggatggtctcgatctcctgacctcatgatctgcccgtctcagcctcccaaagtgctgggattacaggtgtgagccaccgcgcccagcccctacttcttgtttttcaatgttgtatccagtgaccttgctaaatttgcttattctaacagttggcccctagcatcttgattttctaggtatattgtgttgtctgtgtgtaatgtcagtttttaaatttcttctttcctaatcgttatgccttttgtttctttttcttgcctcattatacttggaatagaagtagtattagcaggcattttggtcttgttcctgaaggtaaccattttggtttccattgtgtggtcccgtcacatttgtttcattctgcaggtgctttttggttccttctcagcaggtagtgccccagcagcagggctcactacaaccctgggactcctcagggactcctgggtctgtgagccatacttggttgagcaggctgaacacaccagtatccatcctgtctcaccctcaagtcctcatctaggacatcattcctcttgtcatggtgggtggagccagttcaagtgggaggacaggaggcaggtgtggttggaggaagcagcctgaacctgcctccctgacattccacaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 27572 - DNA, 1700 bp, Homo sapiens
ctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaatt

SEQ ID NO: 27573 - DNA, 1759 bp, Homo sapiens
aagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgcc

SEQ ID NO: 27574 - DNA, 2537 bp, Homo sapiens
acggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttg

SEQ ID NO: 27575 - DNA, 1885 bp, Homo sapiens
acaatctgtggcctcagcccttgccaactctgcctcttcccccgctgactgggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctggg

SEQ ID NO: 27576 - DNA, 2006 bp, Homo sapiens
gcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 27577 - DNA, 2121 bp, Homo sapiens
attgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctg

SEQ ID NO: 27578 - DNA, 1765 bp, Homo sapiens
acggactgctaaaggtctcccctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggta

SEQ ID NO: 27579 - DNA, 1918 bp, Homo sapiens
cttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 27580 - DNA, 1726 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatcc

SEQ ID NO: 27581 - DNA, 4445 bp, Homo sapiens
ggtgggcggggccacgccgtgacgcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactga

SEQ ID NO: 27582 - DNA, 812 bp, Homo sapiens
gaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccaca

SEQ ID NO: 27583 - DNA, 1791 bp, Homo sapiens
aaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatg

SEQ ID NO: 27584 - DNA, 1708 bp, Homo sapiens
agttaccaccgtgttagaaagcagcctcaggaccggccacctccatcactggcgtcaccatgggggctgtgctgggtgtcttctccctcgccagctggaaaatcctggtgagttgaaggccaggcatggtggctcacgccaggatggtctcaatctcctgacctcgtgatccgccggcctcccagagtgcttggattacaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgca

SEQ ID NO: 27585 - DNA, 1894 bp, Homo sapiens
ctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttata

SEQ ID NO: 27586 - DNA, 946 bp, Homo sapiens
gaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgaatgaagatgaaggatcattgatttccttgtgtatggataatccgggaacaggccaactaaatatttgatgaatgtatgatttcaaatacagtgaattccctgggagtcatcaaagaagaccggcattttatggttgtttttattaagtgtatattctttgctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaatgaa

SEQ ID NO: 27587 - DNA, 8170 bp, Homo sapiens
gcgtggccttggccgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttataagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgttatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatatgtgcccatggctgggcgcagtggctcacctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagata

SEQ ID NO: 27588 - DNA, 1615 bp, Homo sapiens
aaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatgaatatcccagcattagttggaaagggatgcctcattttaagtgatgagttaaaccacacatcgcttgtgcttggggcccgactctcaggtgcaaccataagaatcttcaaacacaacaacacacaaagcctagagaagctcctgagagatgctgtcatctatggccagcctcgaacccgcagagcttggaaaaagattctcatcctggtggagggtgtctacaggacctcgtggattatttacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggtgagtacaccacaggccaacgggatctcagtaccagtaccttggattcaaagcaagtccttttgttgagacagcttggggttctctgggtttctcttgggttatttaggaaaacaacactgacaaaagtcactgccaaaaaacaagagctcgtcaacaacagccaacactgtgaccactcagtagatagaaatga

SEQ ID NO: 27589 - DNA, 3830 bp, Homo sapiens
ggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatgaatatcccagcattagttggaaagggatgcctcattttaagtgatgagttaaaccacacatcgcttgtgcttggggcccgactctcaggtgcaaccataagaatcttcaaacacaacaacacacaaagcctagagaagctcctgagagatgctgtcatctatggccagcctcgaacccgcagagcttggaaaaagattctcatcctggtggagggtgtctacagcatggaaggttccatcgtgcatctgccccagatcatagctctaaagaagaaatacaaggcttacctctacatagatgaagctcacagtattggggccgtgggcccaaccggccggggtgtcacggagttctttggactagaccctcatgaagttgatgtgctcatgggcacattcaccaaaagttttggagcttcaggaggttacatagctggaaggaaggacctcgtggattatttacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggtgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataaaatgtgtcataaatatgcaaagaaagggagacatactgttcttatcttgaatatgtgcatttaaatgaattgtccaaaatgcataaatgccttgcgttctataaaggaaacaggaggtcaaaaagacagcgagatatctagtccttccacaaggtatggaaagcaataaacatcttcctttctttctg

SEQ ID NO: 27590 - DNA, 453 bp, Homo sapiens
tgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggtgatttgctgtgtcatgaagatataacttcaaatgcattctgcaaccttatctttttcttccacaagactacatataagtcactacattttaaaataaaaccttttaagggtaa

SEQ ID NO: 27591 - DNA, 572 bp, Homo sapiens
ccagcatggacaatctcctttacagtttcggaagcaggtttgttgccatggagttcacattttgacgggagttgagaagtataaagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgattt

SEQ ID NO: 27592 - DNA, 645 bp, Homo sapiens
aactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggtgaattcacctcatcctggcagaatgccctctgtgtgggaggggtcttgcaagctgactcagtgccacaggggccaccctggtcatggaaaatgggcaggcactcttccctgttggag

SEQ ID NO: 27593 - DNA, 659 bp, Homo sapiens
cgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacgcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcag

SEQ ID NO: 27594 - DNA, 763 bp, Homo sapiens
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 27595 - DNA, 542 bp, Homo sapiens
ttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcccctgttgtttccat

SEQ ID NO: 27596 - DNA, 613 bp, Homo sapiens
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 27597 - DNA, 402 bp, Homo sapiens
ggcgcaggccccagccagctcaggctacactatcccaggatcagcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactga

SEQ ID NO: 27598 - DNA, 425 bp, Homo sapiens
atgatcctgggcattgggagctcacctcaccttctctggactctggagggcacacacatatggtccctgctgggggatgcttcgcacacagaccgtcttccagaggcaggggcagggaaactgctgtcagaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactg

SEQ ID NO: 27599 - DNA, 533 bp, Homo sapiens
ttctgcaaatgggaggtactggaaagaacgtgagggcaggaggagagatatgccagggtatttattgccctagctccccctctgccagaccacaggtagaatagcaagaagtctacatcctgatgatcctgggcattgggagctcacctcaccttctctggactctggagggcacacacatatggtccctgctgggggatgcttcgcacacagaccgtcttccagaggcaggggcagggaaactgctgtcagaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaag

SEQ ID NO: 27600 - DNA, 3535 bp, Homo sapiens
atgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccct

SEQ ID NO: 27601 - DNA, 3656 bp, Homo sapiens
ccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcggaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccct

SEQ ID NO: 27602 - DNA, 2915 bp, Homo sapiens
ccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaact

SEQ ID NO: 27603 - DNA, 453 bp, Homo sapiens
ggacaccaggtcacttcttttccctacatctgactgccttggccacttcagtactatgagagcaacagccatagtcctactcttggctctgacacttgcaaccatgttcagtatagaatgtgccaaacagacgaaacagatggttgactgcagtcattataaaaagttaccaccaggacaacagagattttgtcatcatatgtatgatccaatttgtggatctgatggcaaaacttataaaaatgattgcttcttctgttctaaagttaagaaaactgacggcacacttaaatttgtacattttggaaaatgttaaatctatcttgtgagtccaaaatatcttttaatgcatctattcacaagagtcacatttctgttcccatattatctatgccacattgcctactcatcaccatatgtagatttctttgtagaataaagcagatataaggg

SEQ ID NO: 27604 - DNA, 1801 bp, Homo sapiens
gcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactg

SEQ ID NO: 27605 - DNA, 1630 bp, Homo sapiens
gcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactg

SEQ ID NO: 27606 - DNA, 476 bp, Homo sapiens
ctggctgagtggcaccatgcagcttcaggcctctctctcgtttctcctgattctcactctctgcctagagcttcgatcagaactagcacgagacactatcaaggatctcctcccaaatgtatgcgcttttcctatggaaaagggcccttgtcaaacctacatgacgcgatggtttttcaactttgaaactggtgaatgtgagttatttgcttacggaggctgcggaggcaacagcaacaactttttgaggaaagaaaaatgtgagaaattctgcaagttcacctgattttctaacaagaacacagccctccatggattcgggattgctctgagggccatagaaggcatttgcgtgtgtgtgtgtgtgtgtgtgtgaacaagaggttcattcctctacccccacatttattctccctgatgtgctcctacaagtgcttcatctctgtgcctgaaattctataaatgttgcaatcatg

SEQ ID NO: 27607 - DNA, 2478 bp, Homo sapiens
gcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctttgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatcta

SEQ ID NO: 27608 - DNA, 3820 bp, Homo sapiens
aaactagaaggactgcgattagattaggcaaggtgggaaagggataccggcaagtaaagcgccggaaacttacaacttgggttattttctaactggcgtcttgcaaagggacaccatgtaggtatcccgctcgtcaacttgtaaatgaacttcaggttctctttggtggcaggagaattctgaatgtgagaacctggcggccgttcaacgaccccgccctcggggtccccagggggcgtcctccggcaagcctgatcgtctggggccaaggcgcagggcgagcagggagggaggaggagaaccagggccggtggccccgaaagcacacacaaagcggcctgactcctttggtgggaacttccccggccgccagcggagcgggagcgggagggggcggcggagagggggggcggcggttcccctcgccgaggcggagaacagcgcgcgctaggctctgggcgcgcggcgagcgcagcggccgccgcctcctcccttccccgcctccgccggcgctgcctcctccctccgcccagctcggcctcccttgctccctcccctcctagctggcttcggcggggacggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgaga

SEQ ID NO: 27609 - DNA, 3920 bp, Homo sapiens
ggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 27610 - DNA, 3746 bp, Homo sapiens
gggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaattt

SEQ ID NO: 27611 - DNA, 3175 bp, Homo sapiens
gtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttctta

SEQ ID NO: 27612 - DNA, 1394 bp, Homo sapiens
ttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacggttctcaggaattcttccgccaaaggtgaattctgcagaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgca

SEQ ID NO: 27613 - DNA, 9351 bp, Homo sapiens
agaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcagg

SEQ ID NO: 27614 - DNA, 1245 bp, Homo sapiens
atgataagttttccgtctctacagaggacagaactagaggaaatggacttaattttacagcaggagggatggcagttagacctcaagaggaactccctgggctggaaggatcttcagaggtcatcccatccctctccctgcctccaggcaggacggccccttccccagccaacctgcactcacaggggcctccccaagctgcggctctccgaggaaggagactacccagcttcagcttccacacctgagcccagaggccttattcctccatcagggacattcttgaggtttaaccttgatcccttatgctgcgggccccagcctgttgcttctgttagcagaggttgggtcagctcgcaccactgctctccagagaattgctggctcacgtggctcggagagctcccagcgcctttctcaggcacccctccccccactgccgttcctccaggccaaggaagcaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcagg

SEQ ID NO: 27615 - DNA, 8097 bp, Homo sapiens
agaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcagg

SEQ ID NO: 27616 - DNA, 1773 bp, Homo sapiens
agaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaacccctccccccaacttttcatgtttcttaaaggcattttggttttttaa

SEQ ID NO: 27617 - DNA, 8697 bp, Homo sapiens
cgtcggcgtcggctgaggcgggcggaccggcgaggcgaggcggcggccccaggcccgagggactcgggagctcgagcagcggcggcggcaagacctctccccctcggaggcggcgggcggaggcggcgggtgagagggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcagg

SEQ ID NO: 27618 - DNA, 8829 bp, Homo sapiens
agaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaa

SEQ ID NO: 27619 - DNA, 8477 bp, Homo sapiens
gtcacattgtgcgagagacaaaacccgggcgcgccggagctcacacgcgcacgcacacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtaatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcatagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctca

SEQ ID NO: 27620 - DNA, 5439 bp, Homo sapiens
gttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgacc

SEQ ID NO: 27621 - DNA, 2983 bp, Homo sapiens
cgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaact

SEQ ID NO: 27622 - DNA, 2923 bp, Homo sapiens
gaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataa

SEQ ID NO: 27623 - DNA, 3512 bp, Homo sapiens
gtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgatttttgtcatcttttttgccacatacttaaaattttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctctatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaa

SEQ ID NO: 27624 - DNA, 1194 bp, Homo sapiens
cgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattg

SEQ ID NO: 27625 - DNA, 866 bp, Homo sapiens
tgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaaggg

SEQ ID NO: 27626 - DNA, 1918 bp, Homo sapiens
ggacgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaaaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatc

SEQ ID NO: 27627 - DNA, 3449 bp, Homo sapiens
gctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgatttttgtcatcttttttgccacatacttaaaattttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctctatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaa

SEQ ID NO: 27628 - DNA, 2918 bp, Homo sapiens
gccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataa

SEQ ID NO: 27629 - DNA, 3034 bp, Homo sapiens
aaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaactta

SEQ ID NO: 27630 - DNA, 3784 bp, Homo sapiens
agagaagccttttccgttgccggtgccggcctagcgtcctggaattacttcaatcaacaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttattttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgtttgggtggctggggttaagggaaaatgagacttggaattgtagcttttatccaagttttgagtataaatagggttttgttttgttttttttaacctaaaaactgaaatgccatatagaaaaacagcattgtttttacagtttgtagtaagtaactttttaaagattttatcaaaaagaattgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 27631 - DNA, 2385 bp, Homo sapiens
gcagtccagatgtcgtcagcaccagcgcctgggctggaggacagagaagccttttccgttgccggtgccggcctagcgtcctggaattacttcaatcaagagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaa

SEQ ID NO: 27632 - DNA, 1408 bp, Homo sapiens
gcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagtttgcacatttgtgattctagagagagacgacgacgaagaagcaggagtggcacaagatctcctaaaaagcctcggtctcctaaaagaaaattgtcccgctcaccatcccctaggagacataaaaaggagaagaagaaagataaa

SEQ ID NO: 27633 - DNA, 1534 bp, Homo sapiens
agagaagccttttccgttgccggtgccggcctagcgtcctggaattacttcaatcaagagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactga

SEQ ID NO: 27634 - DNA, 1014 bp, Homo sapiens
ggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaagtgaagcagccgacacgagtcgttgttcataaaacagcttttgaaagttgagagcacacccctggagaaccgactgtgcttgcttacgtttggttcatgacttaaaaatcgagtacaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccaggtaa

SEQ ID NO: 27635 - DNA, 943 bp, Homo sapiens
ttccgttgccggtgccggcctagcgtcctggaattacttcaatcaagagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaagtatttcatggttctatcaaagcagcagtaaaaaaaatactcttgacgcatgaaaattaactgttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaa

SEQ ID NO: 27636 - DNA, 2845 bp, Homo sapiens
agttgttactcaggtgcgctagcctgcggagcccgtccgtgctgttctgcggcaaggcctttcccagtgtccccacgcggaaggcaactgcctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttt

SEQ ID NO: 27637 - DNA, 1814 bp, Homo sapiens
agttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctgcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgtt

SEQ ID NO: 27638 - DNA, 2878 bp, Homo sapiens
gttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctc

SEQ ID NO: 27639 - DNA, 1341 bp, Homo sapiens
ccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctc

SEQ ID NO: 27640 - DNA, 2959 bp, Homo sapiens
agaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctc

SEQ ID NO: 27641 - DNA, 1518 bp, Homo sapiens
tttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcatt

SEQ ID NO: 27642 - DNA, 2054 bp, Homo sapiens
tttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtc

SEQ ID NO: 27643 - DNA, 2387 bp, Homo sapiens
gccgagcgggaagcgaacgcgcgctctctccggttaccttccgcctcggggaagggcgggggaagtggaagcgcgcgctcgcgagctgcgtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaa

SEQ ID NO: 27644 - DNA, 1701 bp, Homo sapiens
tgcgtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttg

SEQ ID NO: 27645 - DNA, 1591 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttca

SEQ ID NO: 27646 - DNA, 1638 bp, Homo sapiens
gacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctg

SEQ ID NO: 27647 - DNA, 822 bp, Homo sapiens
agttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaa

SEQ ID NO: 27648 - DNA, 2815 bp, Homo sapiens
gccggaggaagcgccacgggcggctcagacctgaggccgcaagggcgcgccgggcgggcagggcggagggtccgatttcctccctctgaacggaaaaaaagccactttccctgggaagaactcgaagaagttggatgtctgatcttcaccttggatttgtggtctcggcccgcgggcgactcaccccacccaccaggatcccacgaagccgggccggctcagcccgctggcgccatctagtgtcgaatgaggaggcggccctctgcggctggaggggacgcttgggcgtgtgaaatctgaacggagaggattaaccaaataccatttggacttaaaagcagcttgaggccgggcgcggtggctcatgcctgtaatcccagcactttgggaggccgagacgggccgatcacgaggtcaggagatcgagaccatcccggctaacacggtgaaaccccgtctctactaaaaatacaaaaaaattagccggtgtggtggcgggcgcctgtagtcgcagctactcgggaggctgaggcagaagaatggcgtgaacccgggaggcggagcccagatcgcgccactgcactccagcctgggcgacagagcaagactgtctcaaaaaaaacaacaaaaaacagcttgaaacctcttccagccactctcccagagtgacggacatgcagaaatctgtattccagcctcaattcaagacagccttctagctgcagtcccattttcaacatttcatcagtgaaaatcctttcatttaaaaaatacttcagtgccttagtcttctcaccacaacaaaaccacacagctgtggcatggttgaaaaaagaactcgaacatctaggagctccctgctttgagggcaaatttaaattgcaagcagcaagagctaaggaaaggccaggtatttctgcaaagctaagtttctcctaattagtaatcttctgggtgtctaagaaaaactttagatacaagaagggttgccacttttctcaggagactcttctgggagagatgatgatgaaccgaacgccaaggacttagcaggggcgaacgacgtcaacagatgtccctccagactccggcaccagccggccgagcccaaacgagttctcgcccccgaccccacccaccgcgggagcagggttcggtcactcgcagtgtcagagaggcccacatcctcctaaatttccggccctcccaaaacttccgtcttccctaggtccaacggggtggacccaaggcccaggggcgtccccggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaact

SEQ ID NO: 27649 - DNA, 1500 bp, Homo sapiens
gccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaa

SEQ ID NO: 27650 - DNA, 3683 bp, Homo sapiens
gtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 27651 - DNA, 2489 bp, Homo sapiens
agtctcttcagttccttccgcgtcgtttcttggctgtttccgcccagctcctttgtgccgcgcagaacaacgagatgacgcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataa

SEQ ID NO: 27652 - DNA, 1169 bp, Homo sapiens
gtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcat

SEQ ID NO: 27653 - DNA, 1201 bp, Homo sapiens
cgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 27654 - DNA, 6060 bp, Homo sapiens
cggtgggcgggcgcggggacggtcccctggaacgggtccgaggctctcgcaggcagggctgggccgggcaggagctgcgaggccggcacaagggaggcggccctggggacctgacagggcgggggcgggggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcggaccctcccacgctgctcacgccctctaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagtatgcgggtttacttacaaggaaaccttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaaattctttgagacagggtctctaatatgttgcccaagctgatctcaaactcgtggctcaactgattctcccgcttcaaccttgagtagctgggacgacagatacatgctactgcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgcc

SEQ ID NO: 27655 - DNA, 2962 bp, Homo sapiens
gggcgggcacgccgccgcctgcgcggttccgggtgctcccggcgcggcgctgcccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcggaccctcccacgctgctcacgccctctaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaa

SEQ ID NO: 27656 - DNA, 3601 bp, Homo sapiens
gataggcgccgggcagctgagctggtaggaggaccagacggggaggttcggctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 27657 - DNA, 2211 bp, Homo sapiens
atcattgataggcgccgggcagctgagctggtaggaggaccagacggggaggttcggctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggtgatggcgcccagagtgggggcccaggaggctgtggggattaagagagccagagggaagtggcagcaggcctgagggccgggggcctgtgggaggtgtccgtctggggtccgcctgctcacagctgcctctgatccaccctctgtcaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaa

SEQ ID NO: 27658 - DNA, 1663 bp, Homo sapiens
ctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattt

SEQ ID NO: 27659 - DNA, 1557 bp, Homo sapiens
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 27660 - DNA, 1557 bp, Homo sapiens
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 27661 - DNA, 1620 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 27662 - DNA, 1620 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 27663 - DNA, 1620 bp, Homo sapiens; identical to SEQ ID NO: 27662

SEQ ID NO: 27664 - DNA, 1620 bp, Homo sapiens; identical to SEQ ID NO: 27662

SEQ ID NO: 27665 - DNA, 1557 bp, Homo sapiens; identical to SEQ ID NO: 27659

SEQ ID NO: 27666 - DNA, 1557 bp, Homo sapiens; identical to SEQ ID NO: 27659

SEQ ID NO: 27667 - DNA, 1557 bp, Homo sapiens; identical to SEQ ID NO: 27659

SEQ ID NO: 27668 - DNA, 1620 bp, Homo sapiens; identical to SEQ ID NO: 27662

SEQ ID NO: 27669 - DNA, 1557 bp, Homo sapiens; identical to SEQ ID NO: 27659

SEQ ID NO: 27670 - DNA, 575 bp, Homo sapiens
aggctgaaggtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctg

SEQ ID NO: 27671 - DNA, 1804 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 27672 - DNA, 1804 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 27673 - DNA, 1804 bp, Homo sapiens; identical to SEQ ID NO: 27672

SEQ ID NO: 27674 - DNA, 1804 bp, Homo sapiens; identical to SEQ ID NO: 27672

SEQ ID NO: 27675 - DNA, 1804 bp, Homo sapiens; identical to SEQ ID NO: 27672

SEQ ID NO: 27676 - DNA, 1668 bp, Homo sapiens
ccagcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggagtatccatgggaaccaagcccctcctgactgccatctggcacaagtgcaggcgtttggaggcagtggatgtgtgctgggaagccgctctgtgtga

SEQ ID NO: 27677 - DNA, 2552 bp, Homo sapiens
ccagcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctt

SEQ ID NO: 27678 - DNA, 2492 bp, Homo sapiens
tttgggttagggagagtgctttcgtttgttttaaatgggagaaactggagcatgttgccaagggcagagagccagcagagaggggtgaatggaagaaggagcgagaagggggttactgacgaagccttatcctggaggagagaaggatggactccagagcccagctttggggactggccttgaataaaaggagggccactctacctcatcctggagggagcacgaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 27679 - DNA, 4345 bp, Homo sapiens
gcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgag

SEQ ID NO: 27680 - DNA, 1579 bp, Homo sapiens
gcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaagttagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaatttt

SEQ ID NO: 27681 - DNA, 1341 bp, Homo sapiens
ccagcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaatggagctcttcagccatcggacttggacagaaataa

SEQ ID NO: 27682 - DNA, 3596 bp, Homo sapiens
aaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcaggtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgc

SEQ ID NO: 27683 - DNA, 3326 bp, Homo sapiens
aacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaaaa

SEQ ID NO: 27684 - DNA, 3512 bp, Homo sapiens
aaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaatttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgc

SEQ ID NO: 27685 - DNA, 661 bp, Homo sapiens
aaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaatttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatgg

SEQ ID NO: 27686 - DNA, 563 bp, Homo sapiens
aagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtggtttttcaggaattgttcaaatggatgaagatacacattacgataaagtggaagatgtggttggaagtcacatagaagatgcagtaacattttgggcccagagtatcaatagaaataaggatatcatgaagattggttgctcactgtc

SEQ ID NO: 27687 - DNA, 3085 bp, Homo sapiens
gaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatgggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctggga

SEQ ID NO: 27688 - DNA, 2707 bp, Homo sapiens
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggaccttcctctggggttagttctctggtgccaccttcagtgatctgtgtggcagctctgctgctcacttctggctttactgggttttggtatttaactgttgcttacgcacactggaaattttcacctgcagtttttcttctgcctaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 27689 - DNA, 2558 bp, Homo sapiens
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 27690 - DNA, 2509 bp, Homo sapiens
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggaccttcctctggggttagttctctggtgccaccttcagtgatctgtgtggcagctctgctgctcacttctggctttactgggttttggtatttaactgttgcttacgcacactggaaattttcacctgcagtttttcttctgcctaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacatctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 27691 - DNA, 758 bp, Homo sapiens
tgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggcagggccactacttctcagcacatccggccttctggctcatctcctccctgcatctcactacgcccctccccactccagggcctgaagttaaatcattttggaaagtgatacaggagaggactctgctatgaaacttcctgagtgaaatgataagtggcatgaagaaaaacaaagcaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaa

SEQ ID NO: 27692 - DNA, 3103 bp, Homo sapiens
atgtactcccaattacttctggaagtttctcaaagtactcctttatatgtactgcagagtgtatttttcttcctcctcaactgagatctttccaacttgccaccatgcagctgccaatggtcctagttaagtaaaatgctgccatacctattttagactcagggaaaaatagcacccactcatttttatttttgctcaatataaaaatgaggatacttatgaggatacttaaacttttaggattagctagttttctaaaaatcgaattattcactcctttgtaaagtatgtaataggaatttgctctaataatcaatagattaaggtttaaaatttgaaaccatagtaatgtatgtttaacaccaatattttaagcctttttaaaaaccacaacccacattaagaaatacatttcatactgtgatcaagtacacacgcacacacacactctatacatatatgtctgtccaattaaaagtttcacagaaatttccaaggaggtatgctaaatattatctctttgattctactttatttttaaaaagtggtatcaacccacaaaatggatttcataacccactacgcagtttgataagatgctgttttagaccatgcttttcaccagttttgtggtcctattttgtccttttcatgtctatacaggatgcttctagtgctagttgctagcttttctctgatttccaggatggtaataggttaagaatttctctaaatggttatttcttttctttctgcagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 27693 - DNA, 562 bp, Homo sapiens
gtgcagccggcacctcccggccaaccccgcggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggcagggccactacttctcagcacatccggccttctggctcatctcctccctgcatctcactacgcccctccccactccaggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagtttt

SEQ ID NO: 27694 - DNA, 709 bp, Homo sapiens
gcctgaagttaaatcattttggaaagtgatacagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaac

SEQ ID NO: 27695 - DNA, 582 bp, Homo sapiens
acacaggagggatgggtcggcagagtttgtaagtttggatgggtaataacttaacccaggggattgttggtggaggaacgagggagtcctgtagctagagataggcagaagcagacaggatatttgggttctaggtaagcaaggtgcatctaagacctaagaagtcttcagaggcagcagagacgaacaaatgaacgtgaaggcagggccactacttctcagcacatccggccttctggctcatctcctccctgcatctcactacgcccctccccactccagggtaaattccaataatgctgctctgttccagatggagttcatgttgactgagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttcc

SEQ ID NO: 27696 - DNA, 6409 bp, Homo sapiens
atgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccatctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgaccaaggcagcaggggcttttacctgctaagcggcaatcctttggccctgagaatttgggagagaacagtgcatcaggccaggctcagcaatatgtttgctcacattctttcagccttctgtcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttcttttttttccctccccaggtctagtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttg

SEQ ID NO: 27697 - DNA, 6685 bp, Homo sapiens
gacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccatctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgaccaaggcagcaggggcttttacctgctaagcggcaatcctttggccctgagaatttgggagagaacagtgcatcaggccaggctcagcaatatgtttgctcacattctttcagccttctgtcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttcttttttttccctccccaggtctagtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaa

SEQ ID NO: 27698 - DNA, 1197 bp, Homo sapiens
acaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgca

SEQ ID NO: 27699 - DNA, 4933 bp, Homo sapiens
aaaactaagaggggtgggcagctagcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaa

SEQ ID NO: 27700 - DNA, 4821 bp, Homo sapiens
gcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttc

SEQ ID NO: 27701 - DNA, 4853 bp, Homo sapiens
gtgggcagctagcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagagatgagttgtgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcac

SEQ ID NO: 27702 - DNA, 878 bp, Homo sapiens
agcttggagctcctaggctggggagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctaccccc

SEQ ID NO: 27703 - DNA, 4721 bp, Homo sapiens
agaagagatggggctaaacgccagggaatccgtcccttggcctgaggagcttggagctcctaggctgggggcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcacc

SEQ ID NO: 27704 - DNA, 3576 bp, Homo sapiens
ctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaaca

SEQ ID NO: 27705 - DNA, 2038 bp, Homo sapiens
cgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttaaaactagccaagaacagcagtctggaaaagacatatgtatccaaaattgccagggaaacctgctgtgtagatacgctttctgagaaaccacatgcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggta

SEQ ID NO: 27706 - DNA, 6342 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaaccctta

SEQ ID NO: 27707 - DNA, 1457 bp, Homo sapiens
ggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttaaaactagccaagaacagcagtctggaaaagacatatgtatccaaaattgccagggaaacctgctgtgtagatacgctttctga

SEQ ID NO: 27708 - DNA, 5217 bp, Homo sapiens
aggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatc

SEQ ID NO: 27709 - DNA, 4837 bp, Homo sapiens
agctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggtgagttggggagggcagatgggccattacccagccccaagggacaggcttctgggggcaggcagggcaagggcagaggtggcagctacccgcaggccacagagtttccttggtcttcttccccagccttggggtgggaaagggagacttcagtcctcagcctgagctgcctggggcctgccttgggcttggtgtagctggagatctttggccagagagacctgtgagacagccgagctggagccagtgcccaagtggcccaggccagccctctcagcttcctcctgctgcccaagtcacatttctctgccccctgactcagagttctctctcacccttcctgcttttcatttttcagatgattcatttctccctatttctttcctccccattccctgcactggagaaagtgttgggcctagggtgggggcagagacttgggcaccaggcagcagagggcaggtgatcttagggtgccccctggagggcagggcttggccgagcaacagcattgctgggccctggatattggaaggaccttccctccctggcccaccttggagctccacagtgagcagtgtgcaggtaggaccaggaggggccgtgcctgggagagcctcccagagcctcctggcccccgaggaaagagagttccaatccctacccacctccagcttccaccctttagctgtttggctaaaatcatcatcactagcccgcagtgagtgcctaccccgagggcacctcattcagccctcactgcgggcctgcgtggcctgtgttcttagccccatgttacagaagaggaaacagggttagagaggactttcccaaagccacacagcttagaagtagtggagctaagccttgaacccaagtctcatccggaagccctgctgtctcctgtggtgactggcacggggacaccacttcagcttctgttaccatctgcctagaccatcccagggagctcagcatggggccctgcgtatgtggctcctccaggtgctgcgcccccagcccagggcttgctcgtacctcttgacgtgcattagccgcctcagggctcagagaacctttgcgaggggccagacagctaaggcttctgaggtaaagtgacctctcacgcagccagtgagttaggaagcatgagtctgcgtcagtcccgggtccgcagggcggcctgcaaggggagttgaggttggctggagggggtcagggacccaccctcagcgccactcccacccccggccttgaggcctgagggtgtggtgcctggaagggtgactgcaggagccaggctgccagcactcttgcctgccctcctgtctgctgcgctgccttcatctgggtttatctttgtctccttcccaccctccccgcctcaaaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 27710 - DNA, 3846 bp, Homo sapiens
ggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagtgcacacacccagaagctatgtccttcggcagtaaaagttttacagcacaatatatgtgctctgctctcctcccgcaatcctgctccaagagatcttaagctggaggcaccaggtctgaattccagactcctccccaccacccacacttcacctccaactggagcatgaccacagacccattcagggaggctggcggactcttcatcctggacagtcccttactgtatgtcaagtagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 27711 - DNA, 3628 bp, Homo sapiens
gggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttgctctctgtgccgtaggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 27712 - DNA, 3621 bp, Homo sapiens
gccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 27713 - DNA, 1442 bp, Homo sapiens
acttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggagctggtcagcatttgcctagactctcgggacaacacgatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgact

SEQ ID NO: 27714 - DNA, 1866 bp, Homo sapiens
cttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 27715 - DNA, 1364 bp, Homo sapiens
gtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagcaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctc

SEQ ID NO: 27716 - DNA, 2198 bp, Homo sapiens
aggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccggggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaag

SEQ ID NO: 27717 - DNA, 2470 bp, Homo sapiens
agcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccgagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaacttttt

SEQ ID NO: 27718 - DNA, 2567 bp, Homo sapiens
gtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagac

SEQ ID NO: 27719 - DNA, 1239 bp, Homo sapiens
agcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaagcacccttcacaatag

SEQ ID NO: 27720 - DNA, 1551 bp, Homo sapiens
cttctggatgcatccgagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaaga

SEQ ID NO: 27721 - DNA, 1178 bp, Homo sapiens
gtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtgaaagagtgatggatcttgaagaatttgaagctaactccaggacaggcagaggacaaacaaggatgctgatgaagtcttcttgcattccccatttctcgtctcatgctcccttctcatgcctcccttcatcttcagatgaaacacaattccctctcttttactctgagttgccctctgatttaaccctgaatagtcccctcattagactcagaagcagagttctgagccatgctctttgtcttttgtcaaacaatctctcccactcacagtagtatgtattgcatgaagattaatgtaatgaattggttagaattttctaaactgttaaaaaatgtttttaacatttgaaaggagttaggtacaaattgtttttattaaaaatttctgcctgtctca

SEQ ID NO: 27722 - DNA, 2116 bp, Homo sapiens
gctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatatttt

SEQ ID NO: 27723 - DNA, 2451 bp, Homo sapiens
ctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatatttttt

SEQ ID NO: 27724 - DNA, 2000 bp, Homo sapiens
cacaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagg

SEQ ID NO: 27725 - DNA, 2526 bp, Homo sapiens
gagggctgtgtggctgagcagtgcaaagacctccatcctacactccacagggactgtacatacagattgggagctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaa

SEQ ID NO: 27726 - DNA, 639 bp, Homo sapiens
atggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcatccccacaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgg

SEQ ID NO: 27727 - DNA, 1589 bp, Homo sapiens
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgg

SEQ ID NO: 27728 - DNA, 1581 bp, Homo sapiens
aaaatccactactccagacagacggctttggaatccaccagctacatccagctccctgagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaca

SEQ ID NO: 27729 - DNA, 2660 bp, Homo sapiens
actactccagacagacggctttggaatccaccagctacatccagctccctgaggactgagtgggcggaggctgaaggtgaataatcttgtttgctgcggtcaccggcttggaactcagcccttccagggtctcttgtgcagtagctcatggctcttctctggcttgtagtttcaggaaaggggtagtatgggaggtggtgactgctcggtacgtctaatatgaaccaggtgccttcatcatttatctcacctgagccacttaacaggttgtgcagagacggaaacaggttgagagatgtacagtcacctgcttgccagtacacagcaatcaaaagtggccaaaataaaatcccagtccaagtctgggagactccaaagccctctctgccttctccccactaagaggcccttccaggcttatggtggacacagacaccacgtggcaacctggcaggggcagagaagaacatttgcctttctttggtcttgctgccaaccattatcagggccatcgaggctccagacactgtaccagggactttcatttccctctctcagtcgaccctcactgccacccagcatcacatcgtggaggcctgtggaggccacaccacgtgacatctagaggctgggagagtcactgtggcctctatctctgcccagggctccttcatccctgggttctactttggtggcagttgggagaatgaaggaagggagcccctgctttctaatcccctaggatgagatctgctcaccaagcaggagaggagcaggcattctgattggactgaacctcggaccccccatcagcttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagcacctacctgagggaggctccaaagctagcaagaggcagcaggacagggaccaggacgcaggctgggtggagggcagtgggaggtggtcggggctccatctggccctctgagacttaaaggagctttgcttttcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggac

SEQ ID NO: 27730 - DNA, 3067 bp, Homo sapiens
tggtgcacaaagctgtggtggaggtggacgagtcgggaaccagagcagcggcagccacggggacaatattcactttcagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcatctaaatggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtaggacagctggtgaaacccaaaggaagaacctgtgtcaggacccccagagcggtgtctccactaagcagaagtctctgtttctctcctggcctctcccagaggggctgctctgaagcatgtggatttgatcaggataatcaagtccgagaacagaacacttggttgtcctggcatttcccaagcagggggaggagttctctgcaggaataaataagcctcagcattcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacacgttgcttgtgcctttccatgctgactatcagactctgcgcccctgaggctacctgtgccccaaagacaagccccttgagctcccatgcaggctcagctccaccccaagatctgggctccttctgccttcagctgcagcagcctgcccaggactacctaagcttgtggccaagctcacccagacctcaggcccagggttgggaggggaccctgctgctctaaggccaattcctgccccccaggcttctgggtgcccactttcagtttctctccttccacccccagggcccaggctccacctggctctttccagagctcctagccctgaccacatctggcacagcccccggactccttgctcctgcagctgtgcagggctttatcatgcgacatccttcttctgccctttagcacccccaatttgggggaagtagctactttctgggtttccagatggagcccctcaactgcctcaccagttcctagccctggctctgtgaatgatctccctcaacaaccagaatgcagggctgaggacaaatgagccatcagcgcacaactgcaataaagcaatcgtgtagtcaggcattt

SEQ ID NO: 27731 - DNA, 981 bp, Homo sapiens
cactactccagacagacggctttggaatccaccagctacatccagctccctgaggcagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcag

SEQ ID NO: 27732 - DNA, 1784 bp, Homo sapiens
agagctgagacagccacccagggggtccactccaggacagactgtgccgtgagtaaccccctgagacaatggagacgagagactctagagggagggtgaccaactgttccactttgcccaagactgataattcttctgggatatattttcagtgctaaaaccaggaaagtcccaggcaagctgggacactttgtcactcttgctagaggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacag

SEQ ID NO: 27733 - DNA, 1987 bp, Homo sapiens
aagacagagctgagacagccacccagggggtccactccaggacagactgtgccgtgagtaaccccctgagacaatggagacgagagactctagagggagggtgaccaactgttccactttgcccaagactgataattcttctgggatatattttcagtgctaaaaccaggaaagtcccaggcaagctgggacactttgtcactcttgctagaggtgagaaatactcaggctagaaaggccccgacttagggtccatgggcactggtgggtgactatgcccggagacccagaaaagcctcccccagggacacacagctggtacagggcggcactgactgagggccaaggtcttctggctgccaatccaggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatgaagaccctg

SEQ ID NO: 27734 - DNA, 2012 bp, Homo sapiens
ggagggaggtgggcgactgaagctcagagagggagtaaatgagctcaacttcacacagctagtgaggggctggttggagaccagattttccaagtggttccccgggccctcggggagcagcaagggccaggcgaacctccatgcactgcacaaacatgaagaagtgaaccctcttggggttccccaggtgggaagtggggtgtcttcttgggagggggtgaaccaacttctggtgagttttccttgttgaggcaatgctgcacccgtagcctgtttgttaataattacctggtcgggagagagtgggtggtactgagaaggcctggtttgaccagtcctcctgggcttgataagacagagctgagacagccacccagggggtccactccaggacagactgtgccgcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgcca

SEQ ID NO: 27735 - DNA, 1534 bp, Homo sapiens
attaaccacccaggaagctggcaaacaaaatttaacaggcagcatccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 27736 - DNA, 719 bp, Homo sapiens
ccacccaggaagctggcaaacaaaatttaacaggcagcatccaccgcaggcttactgtacacatgctagggtccaggacagcaggaccaagccagcagaaacagcctgagcccaccgcagactatgaggaaactgaagtccagcgccctctgtgatgtgctccaggtcacacagccagtgtggaggaaggaactggggcttgaatggggtcttttgcctgcctcctcttgcactacgccccattgactcagagactgccacagcatctaacaagcttttctgatttggcagggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcc

SEQ ID NO: 27737 - DNA, 2122 bp, Homo sapiens
tcttactacaggagcaaattgccaattctgctccagtgggagaaaacaaggtttcctcaatggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatgtgaccctgaaagtgaaaaaaaaaggaaaatggaattcaacttgagcaactcggaagaaatacactctgatttccaaacacttatctcagaaatcctcaagcccaacgatgactacttacttaaaacagccaatgcgatatatggagagaaaacgtatgcatttcacaataaatatttagaagacatgaaaacatattttggtgcagaacctcagcctgttaactttgtggaagcttctgatcaaatcagaaaggacatcaactcttgggttgaaagacagaccgagggtaaaatccagaatctcctgcctgatgactctgtggattccacaaccaggatgattctggtgaacgccctatactttaaaggaatctgggaacatcaattcttagtgcaaaacaccacagaaaagccttttagaataaacgagactacaagcaaaccagtgcaaatgatgtttatgaagaaaaagcttcacatttttcacatagaaaagccaaaagcagtgggccttcaactctactacaaaagccgtgacctcagcctgcttatactactgccagaagacattaatgggctggaacagctggaaaaggccatcacctatgagaagctgaatgagtggaccagtgcagacatgatggagttgtatgaagtgcagctacaccttcccaagttcaagctggaagacagttatgatctcaagtcaaccctgagcagtatggggatgagtgatgccttcagccaaagcaaagctgatttctcaggaatgtcttcagcaagaaacctatttttgtccaatgttttccataaggcttttgtggaaataaatgaacaaggtactgaagctgcagctggcagtgggagtgagatagatatacgaattagagtcccatccattgaattcaatgcaaatcacccattcctcttcttcatcaggcacaataaaaccaacaccattcttttttatggaagattatgctccccctaaatcctgcatatctctcaacaaacaagaccatcttacagtgtgaaaaatgtaccatgagatggaaaagcacaattttcacaaaaatgagtttgtagtctaaacctttttcacatttgaatataagtaaatagatcttgaaataatgcattctaatgatcctgtcatatctgtacagctggagagaatgacgatttttatttttaacacgttaacattttgtctaatgtgactttcatttacatttcagaagtactatgctattcaactgaatgccttacaattcttgatcacttgcaatatccatgatacttgttatcatatatttcatatacatcattaaatgaaaaaaaatctttataaaggtgatatgatattgataaatacgaagtttctcaagaatatcgttttgatcaaaaatttagcccggcatggtggtgcacacctgtgttcccagctactcaggaggctgaggtaggaggattgcttgagcccaggaggttgagactgcagtgagccaagatcacaccagtgcactccaacctgggcaacagagcaagaccctgtctcaaaaaaatcattttggtggctcataaattatgattgtaaaactaaaccccctttttctgctatttaaaaaatacttatattgacattagcttaaaaaactagtgaaatccaaatgaaatttgaagtttagctagtagcaatctctcaatgttggtgccctagttttgacaaatgtaccgtggtcatgtaagatgttatcacttggggaaactgtactggagtatatgagaattagctgtattatctctgcacctcttctgccaatctaaaattattccaaaataaaagttttattaaaaata

SEQ ID NO: 27738 - DNA, 3021 bp, Homo sapiens
aaagttccaaggagattttaaggtgcacgcaaggtggaaaaccactgctgaagcagatgtggagaactataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctc

SEQ ID NO: 27739 - DNA, 3114 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcata

SEQ ID NO: 27740 - DNA, 1437 bp, Homo sapiens
actgctgaagcagatgtggagaactataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgc

SEQ ID NO: 27741 - DNA, 1777 bp, Homo sapiens
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatca

SEQ ID NO: 27742 - DNA, 1749 bp, Homo sapiens
aagaggagaggcataaatttaggatctcacccttcattccacagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatcatttaataccgtgtcttctaaatttgaaatataattctgtttctgacctgttttaaatgaaccaaaccaaatcatactttctcttcaaatttagcaacctagaaacacacatttctttgaatttaggtgatacctaaatccttcttatgtttctaaattttgtgattctataaaacacatcatcaataaaataatgacataaaatca

SEQ ID NO: 27743 - DNA, 1562 bp, Homo sapiens
ccttcattccacagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatcatttaataccgtgtcttctaaatttgaaatataattctgtttctgacctgttttaaatgaaccaaaccaaatcatactttctcttcaaatttagcaacctagaaacacacatttctttgaatttaggtgatacctaaatccttcttatgtttctaaattttgtgattctataaaacacatcatcaataaaataatgacataaaatc

SEQ ID NO: 27744 - DNA, 2783 bp, Homo sapiens
gaacatgttggaggccttttggaagctgtgcagacaacagtaacttcagcctgaatcatttctttcaattgtggacaagctgccaagaggcttgagtaggagaggagtgccgccgaggcggggcggggcggggcgtggagctgggctggcagtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacattattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactaca

SEQ ID NO: 27745 - DNA, 560 bp, Homo sapiens
atggtgaacaaaatggacttaggtccattttggggctgttttcaaagacgggctgttgggttgagtactgtcgcctctcatcccccatgttggcagtatttccagctcccaaccctttgagcaccaggaacactgcagagggagtaaaatcacttaaccatacaaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaa

SEQ ID NO: 27746 - DNA, 1604 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27747 - DNA, 684 bp, Homo sapiens
ccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacagggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27748 - DNA, 3265 bp, Homo sapiens
tattagaaattagtaatcttaaaatatgtttggaaaggcttggcaagccaggagtgcccagtgccccaagtattctgtgtaatgaataaagaagagtttgaaaacaaaatatttaaacaagcacagcaaacaagctttatcaggtgtatgagttattgtcttggtttcccgtggctgctgtaacaaatgaccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27749 - DNA, 1495 bp, Homo sapiens
gattctccgggatattaccggagacggagtgttttattattagcctttcttaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27750 - DNA, 1370 bp, Homo sapiens
gacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27751 - DNA, 1338 bp, Homo sapiens
gtccggcttgggttcccttccggagcctcgcagcggcagagaacggcgacgcggccgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27752 - DNA, 1375 bp, Homo sapiens
ggcggctccggcgcctctgcccgccgttctgctcgctcgctccccgctctggagtacgtgtctggcttgggagccgctcggacacgctggcttgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 27753 - DNA, 1357 bp, Homo sapiens
actgcagcctctgcctcccgggttcaagtgattctcctgcctcagcttccccagcaactgagattacaggcacgcgccattacactcggctaatttttgtatttttagtagagacggggttttgccatgttggccaggctggtctggaactcctgacctccagtgatccgcctgcctcggcctcccagtgttgggattactggcgtgagccccgcgcccgcccctggctggcttctttgccgcaagctgtttcatcagcaaagtctttgtgacctgtatctagtctgctcatttttaaatgcgtgttctgcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggaaacaccaccgatagccacaccgaagagttctcccatttgctggttcccggacaaaaaagctgctgatcccttgagcacactgcagtgaagctcccagctgacatgtcctgtccatgtaaacagaacttcctccatgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacagggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtga

SEQ ID NO: 27754 - DNA, 1973 bp, Homo sapiens
gagtgagaagtcttaggaggtaggaggcaggaggaactgaagcccagctgtgaaggccgcagactgcagtgagaggaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacat

SEQ ID NO: 27755 - DNA, 2203 bp, Homo sapiens
gtctactcatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgggggaaaatacctagggctcaacagtcttgagaagtgtggaaacattttctttgtgagtgagaacagatcacctagagaaaggagaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacata

SEQ ID NO: 27756 - DNA, 587 bp, Homo sapiens
tcagtgctgtcaccagtgctgctgctgtcatcaacctctcccttgggagttgagccaaagggaagtcttgggaattttccctgaaccttggtataggtgtgctgggaggagtgagaagtcttaggaggtaggaggcaggaggaactgaagcccagctgtgaaggccgcagactgcagtgagaggaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcg

SEQ ID NO: 27757 - DNA, 560 bp, Homo sapiens
attaaactcatcacacaacatccagatcggataatggtcctcttgtctgcttctccaccttacagcttgtctatgactgatttaagtggtgtcatgggagaatggcatgggaatcggatgccagctgaaaaatttgtgttccatctttgaagagataagctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcga

SEQ ID NO: 27758 - DNA, 561 bp, Homo sapiens
tttcagactcacccaaccagcggccaacttcctctatgaagacagtaaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctc

SEQ ID NO: 27759 - DNA, 1446 bp, Homo sapiens
aataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgggggaaaatacctagggctcaacagtcttgagaagtgtggaaacattttctttgtgagtgagaacagatcacctagagaaaggagaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatc

SEQ ID NO: 27760 - DNA, 1507 bp, Homo sapiens
cagactcacccaaccagcggccaacttcctctatgaagacagtaaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctc

SEQ ID NO: 27761 - DNA, 3387 bp, Homo sapiens
caagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggaggtgggggcctctgccagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatat

SEQ ID NO: 27762 - DNA, 3477 bp, Homo sapiens
caatgtgtacactttttataaaaaccaccctccaaggaccaggcactggccctctctccggtgcccacagacatccacacaggcccaaagaatcagggattgcacaagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatata

SEQ ID NO: 27763 - DNA, 564 bp, Homo sapiens
aggcttgcgatttgctgcgctgtgatttgctgccggatgggagcggggggtgacgcgagcaaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgcca

SEQ ID NO: 27764 - DNA, 580 bp, Homo sapiens
gtgcgtgagagaggggaagggaggaaggccagagcaggaatcagagcgaggcaaaggcgggcaggaactaggagaatgacggcgggaggcggccgggaaagagagtcgcggggctgtgggggtcgccctggcaccagccggggtcccaagccccaccgcgagacccggcgaaggccgagggccgggtcccgagaacagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagac

SEQ ID NO: 27765 - DNA, 1324 bp, Homo sapiens
aatcaaggcggacgtgaagcatctacaaaggaggaatagtcaaagcagcagcggcggcggcggcggcggcagcagcagcagcagcaggaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttca

SEQ ID NO: 27766 - DNA, 4118 bp, Homo sapiens
ccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaattgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccatcacacccagctaattttgtatttttcagtagagacggggtttcgccacattggccgtgttggtcttgaactcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaa

SEQ ID NO: 27767 - DNA, 2437 bp, Homo sapiens
atgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtg

SEQ ID NO: 27768 - DNA, 1798 bp, Homo sapiens
taatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttg

SEQ ID NO: 27769 - DNA, 2195 bp, Homo sapiens
cgataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 27770 - DNA, 2161 bp, Homo sapiens
ttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 27771 - DNA, 2569 bp, Homo sapiens
aatccttggttaggaggaaagggagtggagaggaccgtgctgcctggcgttccccagctgcctttctttctgttttccccccaacggaatctctatgtggtctcctagagcctcgtgcctgcctctcagctagatgctgatatcattcccactcatgtagttgggaaggaagggtgtggcagagataaagggtccacggtcacgcagtatgtggggggtcacacagcctgtatgccaaagtggcacaccctgtgaatatgtagggtcgcacagcctttatgtgtcagtgccagagcctggacccgggtctgtagatgtgtgaaccgtgagctgataccatggatattcaaagatttacatcccatcaatgtttataccttcttgagaagaaatttgtgtcaaagcacactcctcctttcaagactacctcctcgccgtgctgcgtgatagccctagtatcacaaccaaaacacatgatacagaaagaggccagtatctgtgtggcttcaggctcttgtgcgttggccatgaagcaaaggaaggctgttgcatgaaataacctccttctgactccacccttgcatttgtgagatgtaaacagcagtgttaccaagaggtcttccagggaacacgttgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaa

SEQ ID NO: 27772 - DNA, 581 bp, Homo sapiens
atcacagaacaagtgtgccatgacttttcaaacatgcctaattgaactctgtttgcgatttaacttctttttcaaaggtttatagttacctttatttcaaaatttgtcattttaaaatatgtgtttcctccttttcctccactgtatagtaattaagagtgtggaggatttggaggccagcgggctttggtttgaatctagaggctacatattggagggtatgagccaaagccaaatttctaaacatctccaagcccatccgtgagttgggcctaaaggtgtttaggcttaagggccacccctgaagtgttgtgaggatgaagcgaagagtatatcttaggcgctaagcacagtggcaggaatggagctgactttcgggacacgaggtggctgtggttgtggcattgggtaatatttgtcacagaagtacaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattg

SEQ ID NO: 27773 - DNA, 988 bp, Homo sapiens
agcccaggttcatctacatcctgttgagaagtttggcagctggaggtggacatgcacacactacactgaacctcctgcaacaagcactgcggaagggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagac

SEQ ID NO: 27774 - DNA, 1716 bp, Homo sapiens
agtgatacccgcagctgggagcaccggggccggcgtggctcctgcccggccatccgagccggccctgaccctgaacctgaggtttccagctgctcgccggcaacccctaccccggacttaggctgcgcgccgccggatggggagagactggcgcactcttacttgttacctctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagca

SEQ ID NO: 27775 - DNA, 546 bp, Homo sapiens
gataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcgggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatgg

SEQ ID NO: 27776 - DNA, 1539 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 27777 - DNA, 1907 bp, Homo sapiens
agtttcccgggagagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatg

SEQ ID NO: 27778 - DNA, 1890 bp, Homo sapiens
gaaggataggctgagccggggctcccagcagagacgcctgggtggggcaggaggccgctccaggtgtgagccacagaggaggggagagggacccccacgggagtggaagtggcagagcagctgcagaagtgcagggagcggaaaggtaccagggcagctgctttccgctgcctccggtccgggcagctgcagaaacagcagggggaggagcaacagctgccaaattcgccaactagaggagggagaggcggagcttgggtccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtg

SEQ ID NO: 27779 - DNA, 842 bp, Homo sapiens
tttcccgggagagacgaaagcaggaacgagagcggagcggagcacagtccgccgagcacaagctccagcatcccgtcaggggttgcaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccat

SEQ ID NO: 27780 - DNA, 582 bp, Homo sapiens
gaggggcctgtggtggggatcctggggctgtcgggctgagtatgccgtgtgggtggagaggaagcctcggggaaatcgcccaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaaca

SEQ ID NO: 27781 - DNA, 1406 bp, Homo sapiens
cgcggctcggctccggggcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggaggg

SEQ ID NO: 27782 - DNA, 1523 bp, Homo sapiens
tttacagatgaggaaactgaggccctgagaattgactcattcagatcacttcccatgatcacgcagctgagcagtttccaatacagaattcagatttggggttccctacttccaatccaggtctctgtgctccacacttgtctttcgtgctccatgtttgaagaaattaatattgtggaagaacagttttaaggcttagaggaacttgagttaggatccgtacttggcagatgaggaaattgattctcatggatgtaaattcactgtttgaggccacaacagggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaagg

SEQ ID NO: 27783 - DNA, 615 bp, Homo sapiens
tccccagggaccacatccagcttttcttcgctcccaagaaaccagcagggaaggctcagtataaatagcagccaccgctccctggcaggcagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtgg

SEQ ID NO: 27784 - DNA, 675 bp, Homo sapiens
agggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtggaaa

SEQ ID NO: 27785 - DNA, 583 bp, Homo sapiens
aggcagggacccgcagctcagctacagcacagatcagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaa

SEQ ID NO: 27786 - DNA, 563 bp, Homo sapiens
tggcagacagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatttgttgaaaca

SEQ ID NO: 27787 - DNA, 1022 bp, Homo sapiens
tggcagacagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagtttattttcagctgaactgtagagagtgaaggaagaagccttttttcttcactcctacatgacccaggcattgatccaggcaatgaagattcagtgtaaataaccaccactaacaagaccatggcctttggaacctgtgctaagaggcatggatgagctccctcagcatgtggatggagactgaagagaggtctgaaggctcagtgtggtgtctccattctctaagaagtttggaggagaagctggatacagcaaaacagactgagaaggagcagctgttgggaaaggaggaaaactaggaaagcatggtgttccagaatccctgatggagatattgattagtagtatcagattctgcttagcagttgaggagttcacctttggcttaagcaacatggagtcattgactatctcgtgaaggtggttgcaggagaaggtctggagaactaaatggagcagtgataagagagaatgggagatggtatgataggactcctggacaccccagacatcaatcaaaacaccacagacaagaaggtgtggatacaaaaactagcagttagaagaaataatagaaaatgaactccaactacttctgaaaaaaaagtaatgagggcaattaatacattgaagaaagcctcaataagtacaacagtgtagtactgacttatatatagaaaaaacctgatcagtggaaccaaatcctcagaattagacataagtgcatatgagaattttgtatgtgat

SEQ ID NO: 27788 - DNA, 687 bp, Homo sapiens
agggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 27789 - DNA, 610 bp, Homo sapiens
agacagggacccgcagctcagctacagcacagatcagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatt

SEQ ID NO: 27790 - DNA, 727 bp, Homo sapiens
aatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcatctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactgctatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattgaatttgtt

SEQ ID NO: 27791 - DNA, 3229 bp, Homo sapiens
ggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaatatttctttaaggaagttcaaaaggatgttgtcttgttaacactggaacgaatataaatcttcaaaatacaattaatatatactgttttgtggaaacttagctcatactattctttaatgctcttcaaatttaaactaacccttacattccatgtgatgtgatgtaggcttataagatgctaaaatctataggttttggaagtgaaagattctattttttctttttttgtacataatgggaatttcattccagattatattttatttacatattaatttcacagaatattaatatttcttaacttcttaaagcatgctagcgttttatgtatatgtacacatatattcagacagggtaattttatctgctgcctaacattgtactaaaatattgctttatctgtttttaattacaaaatgctaatgatttcttaaattatagtttaaagacaattggcccaggaagcaaatcccctgcctttagtatgaaccactataagtaaccttacaaatagagttaatccaagacaatattaacaaactgtgctttgtctttaataaaagggataggattaacaaacatattgatggcataacctattcagctatgtccttatttttgcaataatgtaacctcaaatattggattgttgaaccaacaatggctgtgttaaagaagattaaataaaccgaaaaataaaaagcatgaaacaa

SEQ ID NO: 27792 - DNA, 2855 bp, Homo sapiens
gtggcgacgcagccgcggtctgagagaccggttcacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaagaaatttcaaagaacaggctccaaaaacaagatccctagattttccacagaatgagcctcagatcaagaatcagtttaataagaagctatcaggaagacttgaaaatacaaaacagcaattgcagctgcctcttcatccttcatgggaagcaagcagaaggcgaaaagaacagcaatctaatattgctgtgtttcaggggaaaaaaattacgtttgatgattgattagtgcctctttctgcaaacttttccatctaaaaaaaaaaatgttttttttaagacaggatctcattctgttgcccagactagagtacaatattgcaatcacagctcactgcagcctcaaactcctgggctcaagtgatcctcccacctctgcctcccaaagggctgggactgcaggtgcatgcactaccatgcccagctttctcaccccaggctctgcagctattacttaaactcgtatttgaataagtctcttggggagaattatagaatgtttgtttttgtatttttttttaaagtaaattcaacttacgcttatataagcctttcacaaatccaatatgtacttaaattgatttttaataatatccctcagactgtttcccttatgaagtaatttggggattttagtgatctcatattttctctttagtgcttatcatgaaatgtgcttcactggttcagctctgttgtttccttaaacataaatgtcaatatatatttaaaataataatggaaacataggaaatcagctatttaaaccagatcacccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacattagttcctttaatggcagggaaggccatctggttaacctgtattcacaaactctcaagagtttctacttatttcaggagcttaagaatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagaaaattatccaggcgtggtggccggcatctgtaattccagctactcagaaggctgaggcataagaattgcttgaacctgggaggtggaggttgcagtgagccaagattgcaccactgcactccagcctgggtgacagagtatgactgtctcaaaaaaaaaaaaaaa

SEQ ID NO: 27793 - DNA, 2401 bp, Homo sapiens
ttttttataaggccgagcgcgcggcctggcgcagcatacgccgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatattta

SEQ ID NO: 27794 - DNA, 2414 bp, Homo sapiens
cagcatacgccgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaac

SEQ ID NO: 27795 - DNA, 3201 bp, Homo sapiens
agatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttacatata

SEQ ID NO: 27796 - DNA, 2686 bp, Homo sapiens
gcagattgtacttcttcctttagtgcagagacgacttttatttccgccccctcccctccacattcctgacctctccctcccccttttccctctttctttccttccttcctcctcttccaagttctgggatttttcagccttgcttggttttggccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactggctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 27797 - DNA, 553 bp, Homo sapiens
aatcaaaaacaactctcctctctcaagccgcctccaggagcgcatcacctggagaagagcgactcgctccccgcgccggccgcggaagagcagccaggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttct

SEQ ID NO: 27798 - DNA, 1850 bp, Homo sapiens
gctcccttcctgtacttaaattgccttgatataaagtggggttcataacagaacagggatagccgtctctggctcgtgctctcatgtcatctcagagttccagcttatcagaggcatgtagcagggaggcttattccagccataactgggctctacctccagcctccagaagtaatccccaacctgcatatccttgggcaacccgaagaatgaaagaagaagctataaaaccccctttgaaagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaag

SEQ ID NO: 27799 - DNA, 560 bp, Homo sapiens
aactgctcttcagtgtgccctgagccggctgtgccttctctccatccgctgctcagatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttc

SEQ ID NO: 27800 - DNA, 2164 bp, Homo sapiens
atgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctctcatgcctgctcctccctgtccccccagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 27801 - DNA, 1891 bp, Homo sapiens
agtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 27802 - DNA, 1906 bp, Homo sapiens
ggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 27803 - DNA, 2225 bp, Homo sapiens
agggctgggaggttgaacttgagccggtttgggagccaggagcgagtgggtgacaggtcattcctgactgggaaggttgcttgacaagtcaggattgtgcctccagtcagaaggaccatgaagagagagaagagggcagagccgtgcatggggctgctccccaggacctgagcaggaacctggagttttcagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 27804 - DNA, 676 bp, Homo sapiens
actgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgag

SEQ ID NO: 27805 - DNA, 1759 bp, Homo sapiens
gtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagc

SEQ ID NO: 27806 - DNA, 1798 bp, Homo sapiens
atgcaggggttgcttacctcgggtaggaaaccctcaggcggtggcaggtgcacagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttg

SEQ ID NO: 27807 - DNA, 4220 bp, Homo sapiens
gggatccggcgccttccccggctgtcctcggcctcccgcgcgctccgcgggaggagccgccagcggccgtgacgcgtcaaggaggaaacgccggcgcccggcggccctgccgggaaggaggaagcgcagtgcgttcggctccgcgcccgccgcgccgggagcagcaccgcggggccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagc

SEQ ID NO: 27808 - DNA, 4055 bp, Homo sapiens
aggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaa

SEQ ID NO: 27809 - DNA, 4135 bp, Homo sapiens
gggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagc

SEQ ID NO: 27810 - DNA, 2949 bp, Homo sapiens
agttatggcagtgggagtcgaagcgagggtctgaagttcacgactactagaaggggaggggagtggaaaggctctcagtgaaaaaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgaatgtctcctgtcttcctccagcattcacaaaccaggaacggctagctttttgacctgttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaa

SEQ ID NO: 27811 - DNA, 2483 bp, Homo sapiens
gggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctcc

SEQ ID NO: 27812 - DNA, 3000 bp, Homo sapiens
actgcgggcggagcagagggaaacaccagagtctgtgactccagacaggacccactgtgtcctcttgaactttgcacagcgcgtgacgggggcagacggtgcaccgtggcccggcctttcgcgggggtcctcggggaagagagaggagcgcgggtttcctcggaggcctgagcgggacgcagcctgcagcccctccccgcacgggctgcccccggcccgccgctcgcgccgctctgctgggatccggcgccttccccggctgtcctcggcctcccgcgcgctccgcgggaggagccgccagcggccgtgacgcgtcaaggaggaaacgccggcgcccggcggccctgccgggaaggaggaagcgcagtgcgttcggctccgcgcccgccgcgccgggagcagcaccgcggggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaaaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtg

SEQ ID NO: 27813 - DNA, 3106 bp, Homo sapiens
ggcgccgctgggagctggtggcgcggcgcaggtcccggccgagtgtggcgcagcagtggcggcgcttcccattcgccatgcgccgggggtgggtgcccgaagggatttagacatagtggactagtggctgttgcctgtttctagtgaggacttctgctgccctttctgttttgagttcccattctgcaaaccccccctcacatgcggcccctgccgttccctaccaaatatctaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaa

SEQ ID NO: 27814 - DNA, 1852 bp, Homo sapiens
gcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggaggg

SEQ ID NO: 27815 - DNA, 1882 bp, Homo sapiens
gaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaagagaaagaataatctccatttatctacacagaacaagttggaggcttccctcttctcacccaagaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccc

SEQ ID NO: 27816 - DNA, 1630 bp, Homo sapiens
agtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggtgcggctggatccaggtgctggctccatatttggtcctacgttcctcccattcccaggccagctttctctccttgtggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctg

SEQ ID NO: 27817 - DNA, 2059 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaagg

SEQ ID NO: 27818 - DNA, 2215 bp, Homo sapiens
agccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 27819 - DNA, 2070 bp, Homo sapiens
ttcaaacaaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 27820 - DNA, 2065 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggtgcggctggatccaggtgctggctccatatttggtcctacgttcctcccattcccaggccagctttctctccttgtggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaagg

SEQ ID NO: 27821 - DNA, 1967 bp, Homo sapiens
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattga

SEQ ID NO: 27822 - DNA, 1118 bp, Homo sapiens
gtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccaggcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttc

SEQ ID NO: 27823 - DNA, 2718 bp, Homo sapiens
tgaaacagcctgtggatatgccccctcgattgtcttgtcttgtgaaaacagattatttagccaccttcatcccctttgcctcctacttaaaagagagagaaagaaaaaaaacacatttgactcagggaagagatgatgttgcctggaataagtgtgtcctgcaagctctatgacgttatgcacagcgtttactcttgcgtattaagccatcccttttctgaattgtcctttagaaagaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaa

SEQ ID NO: 27824 - DNA, 2676 bp, Homo sapiens
gccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaa

SEQ ID NO: 27825 - DNA, 3509 bp, Homo sapiens
gattgccagggccgccctgtgccctctggctcggcggtggtgggcgagggctcagggatcggagaagtagcgtcttcccgggggtgccgaattggcggggctgggggacgctttttttcaccgccgcccgccgagactacggctgcccgagactgccgccctccgacagcgcccaagcctccggccgctgcggccagtgggccagggttcggcgagccttccctgccggcgccggccggctgctgaggcgctgggaggagctgcggagggcggggactggtgtcggagaaggggcggggtgggaacgccggagagaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaatttta

SEQ ID NO: 27826 - DNA, 1671 bp, Homo sapiens
gcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcggattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagta

SEQ ID NO: 27827 - DNA, 1078 bp, Homo sapiens
gcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcggattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaacctta

SEQ ID NO: 27828 - DNA, 5735 bp, Homo sapiens
gggcgggccggctggctgggaagatggcggcgggaacctgggccgccgccgccgccgccgccgccgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctga

SEQ ID NO: 27829 - DNA, 3090 bp, Homo sapiens
gggcgggccggctggctgggaagatggcggcgggaacctgggccgccgccgccgccgccgccgccgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacagcaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccaggtgctggtccagccagcggctgcaggcgagtttctagaaccagagtctatataaagagagaactaac

SEQ ID NO: 27830 - DNA, 6253 bp, Homo sapiens
ctggctgggaagatggcggcgggaacctgggccgccgccgccgccgccgccgccgccgcggagcgaaccaggggtgtccggggtgcgcggtccagggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccacgctcctgtgcctgccttccccactccccggctgcctgctctcggcctacc

SEQ ID NO: 27831 - DNA, 5789 bp, Homo sapiens
gctggctgggaagatggcggcgggaacctgggccgccgccgccgccgccgccgccgccgcggagcgaaccaggggtgtccggggtgcgcggtccagggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctga

SEQ ID NO: 27832 - DNA, 7439 bp, Homo sapiens
ggttgtcaaacatggctgaagcgctgccgctgccgctactgccgctgcagggaaaatgctgagccctcccgggccgggtgggcggcggcggcgagggcggcgacggggacccgcttcccgagcgcggcggcggcggccatggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggaattcaaaatgtcctcagcctcttttgtgcagtcctcacagaaaataaggttctcttccattctgcaagtttccagagacttagtgatgcttgtagagccctggaatctttaatgtttcctcttaaatatagttatccttatatccctattctcccggctcagctactggaagttctaagttccccaacgcctttcattattggagtacattctgtctttaaaactgatgtccatgaacttttagatgtaatcatagcagatttggatggaggcactattaaaattcccgaatgtattcacctctcttccctcccagaaccacttctacatcagactcaatcagctctttctttgattttacacccagatttggaagtagcagatcatgcttttcctcctccacgaacagctttatcccactcaaaaatgctggataaagaggtgcgagccgttttccttagattatttgcacaactcttccaaggatatagatcctgcctgcaacttataagaattcatgcagagccagtaatacatttccacaagacagcattcttggggcagcgtggtttggtcgagaatgatttcctcactaaagtactcagtggaatggcatttgcaggttttgtttcagaaagaggtcctccttatagatcttgtgatctctttgatgagttggtagcctttgaagtagagagaattaaagttgaagaaaataacccagtgaagatgataaagcatgtcagggaacttgctgagcaactattcaaaaatgagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttgtttcgataatggacaaggtgacgacagttttcaacagtgcacaaagactagaagttgtcagaaactgtatctcattcatatttgaaaataaaattttggaaactgaaaagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggattgttcaagtttagaagaatacaacattgccgcagcattactccctttgaccagtgctttctataggaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggataagcttcctgatgaccattatcaggagaagacagcaatggacctggcagctgagcaactacgcctttggcctaccctgagcaagtcaactcagcaagagctagtgcaacatgaggaaagcactgtctttagtcaggccattcactttgcaaacctcatggtgaacctgctagttccactcgacacaagtaaaaacaagctcctaagaacatcagcgccaggtgactgggagagcggaagcaacagcattgtcacaaacagtattgcaggaagtgtagctgagagctatgatacagagagtgggtttgaagattcagagaatactgacattgccaattctgttgtgcggttcattacccgatttattgacaaagtttgtacagagagtggagttactcaggatcacatcaagagccttcattgcatgataccaggaattgtagctatgcacattgagaccctagaagcagtacatcgagaaagcagaagacttccgcctattcagaagcccaagattcttagacctgctctgctgccaggagaagaaattgtctgtgagggtcttcgagtcttgctggatcctgatggaagagaagaagctactggaggtcttcttggaggccctcagctcctgccagcagaaggagccttgttcctcaccacatacagaattctcttcagaggaacaccccatgatcagttagtgggtgagcagacagttgtgcggagctttcccattgcctccatcaccaaggagaagaagattacaatgcagaaccagctacagcagaacatgcaagaaggactgcagatcacatcagcatcttttcagttgattaaggtagcatttgatgaagaagtcagtccagaagtagtagagatctttaagaaacagctgatgaagttccgttatcctcagtccattttcagtacctttgcttttgctgctggacaaactaccccacaaataattttaccaaaacagaaggaaaagaacacttcttttcgtaccttctcaaaaacaattgtgaaaggtgccaaaagggcagggaaaatgacaattgggcggcaatatttactgaagaagaagacagggacaattgtggaagaaagagtaaatcgtcctggatggaatgaagatgatgatgtatctgtttcagatgagagtgagctccccacaagtaccaccctgaaggcctccgagaagtctacaatggaacagttggtggaaaaagcttgtttcagagactatcagcgtttaggtttaggaaccataagtggcagctcttcccgttcaagacccgagtattttagaattactgcctccaacaggatgtattcactctgccggagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccgctcctacctcctctttagaatcttccagtagcatagaacaagagaaatacttgcaagccttactgaatgctgtttctgtccatcagaaactcagaggcaacagcactcttactgtcaggccagcctttgctctatctccaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatatttggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggacatcactgcacaagtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatctggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccac

SEQ ID NO: 27833 - DNA, 9899 bp, Homo sapiens
ggttaagtggagctagagagctacattgtaacctagttggatttttttggggggggaatgtatcagaatctaacgtgtcgttaatagaaagaagaacaggcaagaagtggtccagccggcgaagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgagaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacgtaaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcagagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcagaatgaatatgaagaattccatttccgtagatgttttctaaaagtcagattgtggaaatttcaaataagtattttcaatttcctccctcactccctcttaccttccccaagacatcaaacacctggcatggtagattatagaaagagacactgagagagagaattaaattttctaatgggaattagaatatctggtttacctccaaattaagtttctttacaggaagttgggaccagctggaaattgtattatcatttcggaacacaatattacttccttagagagagatggatttttgttggcaacataaaagaataagtgatggggtatctatgtgagtaaatttttaaattccaagttaatatgcttgcaaacattactgctgcgttatggcaccaagagttggttgaaattacccacgtagtcatactcctgtgctctgtcaccatggacttcacatcatttgctgcccactagttcaatcgcatttaatcctagcaatatgtaagtttaaaggactgcattcccctctactttaaagcttatatcctagatactcagtttgtgaccttggttgacctttggcatttcacgcaagttgaacagcaaaatcaaagcagccatttttaattcgtcattcccaagccctatctgagtggttccaaagtcacctgagaggaaggtttaaattagtccctctcaccccaccattgctataaaacagcaacgttttcattccaattcagccataaagaggtttctcttcttactgggttttgaaatcatttccttttttctttcgtttgcccttcttccttcctgtgttgtactatctctccaaccacgtctataagcagactcaatcttcttgcagaggaagatgagctggcactctgcaaacttctttaataaggacccaaagtttacttgacattaacctctagtaggtgagaaattccaaaaaagctttggggtacattagaatttccaaagctctgaaagatatttcaggagatttaacagcagagttgcaacttacacgtgaattctggtctatagtggtcatgtgagttaaattcgaatcctctacttgtatgaccctaggaatagattggaatactgcagaggaccaaagctgaggcatgctaaacagctgcttggaggtggaagcaagttcagtcacctactcagcttcctctctccaccacccagttcctccctcagtatcacattatttttttcttctgcttttcattaacctaactcatctcatcagtacaaccattttcttattctctaactacccccaattcctttagcctctccccacctgtccaaactcagctcagccgtgggccaatgcagcttacagacggttgcagagctaggaagaaaacccagctctcccaaccctgatcgtggaggtctctggccccccaacactgccttctgggggctgcattttttttttttttttgagaagaggtcttttgggatgcatggtgctccacatacagcttcacaaaatatttcattataagagaaaccccttgatttttatttctttttcttttgttttctggattacctgccttcagtaagcagatgcagacccacttgtaaggagtctggttagtgatgagaaaaggatgaaatctagatacaaaagtcaccttgaaggtgatgatggatctttaatccacttgactaagtgtctggaagagctacttgctcttccacccctcatctcaaatgagaggagcagaagtttaacttcctcaaatagcccagctctggctaaaacccaaagaagaaaggtcaaaggaagggaaagcatgtcaggggctggtttgtgacttggcaggaccaggaaacagcagccactgacagcccagagaaggtgactaagggctggcagaagattagaatgttaatttggctgctgtccggactaggaggccatgttcaatggcagtcagaatttgtgttctgcgcattgctgggtctataaatatgataagcaagtggtgacagaattatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatgaacatggacttgctgttatttgaggcgtagatacatctagcatgcttactgtcatgctcctccatggtcttagatgttgggttttaaacatttttttctaaaagaaagctcagtcttttccgctaccagatcaggttagcacagtatagagcacttaactattaaaaaaaaaaagttaatcctattcatatgttattcattgtgtgaaattaaagacattcaattcagtctaa

SEQ ID NO: 27834 - DNA, 1785 bp, Homo sapiens
aagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatggttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacagattaaagactccagtaaggaggaagtctggaagagaagaggaggccaaggcatcccattcaaaaagcaattcctgtcccaggaacgtgccatgtgcttctcatgcccccggaacccattccccgcaaaacccggttctctcactcttccttttcacagtgaacctgcagtctgggcacaagaagtataacttcgcatggattctgcaaagcccacacctgtggtcattccctgttctttccattcaacaatggagacttgcccaagattgtaaactagtgagtgacagcatttgggcttatgatcttctctgcctgctagctagacattctctctgggtctaaaagataatccaaaaagatccagcttcacaatgctgccctgaagagataatgcattaggcggccctgatgcagcattcactgtcttccagggcaggcttgatcccatgagtttgcttgctcagacgatcacttaggaaacacatgcctttactctctaggccttttttctagcttgccttgtatcagctatgccatggatctttgctctcttaccccatgctatacagagtatgggctccaagccacagctggcctgtcaagtgtgtgtcgctggtccaccatgggatacatttagaaacttttatagcaatttgacatttttgtgatatccaagcatgtgattgttttcctacggatttgtcttatagtattttaccaaagtttccacacaaaaagtatggattaaggacaaagtatctggtccttcatcaaagatcgtttgataagctctgttctagttaaccaacactgagctttcctagttttaataaaagagtaggatttgga

SEQ ID NO: 27835 - DNA, 762 bp, Homo sapiens
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggg

SEQ ID NO: 27836 - DNA, 2443 bp, Homo sapiens
acaagtcccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagttataatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcat

SEQ ID NO: 27837 - DNA, 1671 bp, Homo sapiens
aggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgaggtgagtctgttcagtgataagcagcttgcccctccctatagtggaagacagtggttggctagctttacctctgcctagttacataagtttaactcaggaatgtggcagagactgcaagttgtccatcagtatcctttcccctttctgtaatagaattctccatttaacaaaagtacatgactacccagaatactcactttcctagttagatttgtcttagtgactgttctagttaataggatataagcaaaaatgacaagtccttaaatggagatatcctgcccttcacctcctctttcttcctgctggctggaatgtatacatgatgactggaactggagcagtcatcctagaccccaggatgaccctgggaaaggaagccattgcatagaaaaatcaacaaggttaaaaggagtctaggtgtctggtactgtagaacatcctgtcagtcgtgatctgacacctttgtactttcaggtgagaaatagtctctcccttgcttaagtcactgttattgtaagttttctagcactaacatcgaacctaataatgatccaagaaacccttgtggctgcatacctaaaccctgcttgccaaccaattttaacagtaataaagctgactttttgatttctgtctga

SEQ ID NO: 27838 - DNA, 1676 bp, Homo sapiens
aggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagccta

SEQ ID NO: 27839 - DNA, 7365 bp, Homo sapiens
gggaacacggacagtgcacgacggactttcaagttgctcccggcacaacgggaggtcgggagctcggagcccctacgggcggtccaagtgtccgcgagaagcccgcagcgcccaggaccgcgttgagcgctcggggcgcgccaagccgcacctaagcaaaagagaaacgctgacgggccggaggcgggttggctgggacgcggaatacgcgcggccccggagcgcctttcgttttaaggagccttacttctggaaagggacagggaactgtcaatcagcgagggagggagcgcaccggcgctgggtgatgtcagcggatcagctgctcgataacaaagagagggtattacaggagaaagttgcagcagcggcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatatgtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagaaacttggatctatgcactacgtttatctgacaatgggacaaccagggactgctcatgctgtgacgtcacatcctctcaccatgcgttagcaacgactttctcgcatactaactaggtttgactgtattactcataccagatttaaaattagctagccttgcaacaacgtcctactgagaggtattgtcgagcatttgacataagacagcgtgatgttctttggtggttcaagtctaaatctgtaccacattcggagatgccaaatgattagactgaaacagggaaacggggtttttcagtcatttttagtcagtggtttttccatagtgcttttttcctatggccagtgcaaattgtgttagcacacttgcatatgtgccgtattaagggttgacaattactacatctttattctctaaatgtagtataatttgccttttaacctttgatctgtatcttgcaatagaatggctttggtttttttcttagtaaataggagcccacttctaaagtcatttcacccctcagccctattctctttcttagataccctttacaagagaaaacttccaaatggatttttgcatcaatagcagtgtgtaggtctctctggttctttctatatcatcattttattattatgtcctaatataaagtactggctcatagggccagggtattattatagaatattattctcgcatgtaaacaaagatatctttgctttaagatgtgagaagaaatgaatttactttgtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaactaagactgaacacctgtatagtttaaaagcaacactatcaatagcatttcagccattttgccagccatgtgtaatcacaactgcagaaataaggagaaaacccctgtttttttagtttagctaattagatctgtaacatcactgggattgctctgaatgaatcctgagagttttgttttttataagcaccctcaccacatgccatagctttgtctcttttagacacctcgatgcagcggctggaaggactggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatacggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaacattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatcatc

SEQ ID NO: 27840 - DNA, 6451 bp, Homo sapiens
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaagccgactctccgggggatgcggccaatctccaagctccctgggccgcaacttccgagcctcccagggcgccggccgaggcgaagccgctaccctcggccccgtgggtcccccggcagcgcctgtggcgaaagtgcgaatgcagaccctgtgcccgctgggcctcgcgcagtgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggccacacgggaggaaccccctggagccccttttgctgaaaatacagctgagcgcttcccaccttcttacacctcctacctgccccccgagcccagccggcccaccgaccaggactaccggcctcctgcctcagaggctccacccccggagcctccagaacctggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagcctccgccacctccccctcccccgccgcctcctcctccctacctggcgtcccttcctcttggttatcctccccaccaacctgcctacctcctcccacccagacctgatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcacccctgcccaccaccccctgattgtttttctttgcggagaagaagctgtaaatgttttgtagcagccagcagctgtttcctgtggaaacctggggtgccggcctgtacagattctgtcctggggggctacacagtcctcttgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtacaaaa

SEQ ID NO: 27841 - DNA, 315 bp, Homo sapiens
ggtgccacctttcggccggaggatcggggcgcggggaggagagcgggtgtgtgggagccgtggccgggctcggcccgggccgctggccgtgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaa

SEQ ID NO: 27842 - DNA, 926 bp, Homo sapiens
caaggtcccgggccgcagcatctagatcgtcgtggcgaagccgactctccgggggatgcggccaatctccaagctccctgggccgcaacttccgagcctcccagggcgccggccgaggcgaagccgctaccctcggccccgtgggtcccccggcagcgcctgtggcgaaatgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacaca

SEQ ID NO: 27843 - DNA, 8195 bp, Homo sapiens
aacggcatggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggaggaacaggagagcaccgaggaggaagaggaggcggaggaggaggaggaggaggaagatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacaga

SEQ ID NO: 27844 - DNA, 8185 bp, Homo sapiens
gggggacaccatgtactggctggcggcgcagggaggccggcgcccggcggggatgttgggttaacggcatggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggaggaacaggagagcaccgaggaggaagaggaggcggaggaggaggaggaggaggaagatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaatt

SEQ ID NO: 27845 - DNA, 8142 bp, Homo sapiens
gctgcggggagggggctcgcgtcgccgtctccagccgctcccgatgaagcagctgcagccgcagccgcctccgaagatgggggatttctacgacccggagcacccgacccctgaagaagaagaaaatgaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttt

SEQ ID NO: 27846 - DNA, 8431 bp, Homo sapiens
gcgtcgccctgctgcggggagggggctcgcgtcgccgtctccagccgctcccgatgaagcagctgcagccgcagccgcctccgaagatgggggatttctacgacccggagcacccgacccctgaggaacaagagcctgaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattctaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagtt

SEQ ID NO: 27847 - DNA, 8431 bp, Homo sapiens
gcgtcgccctgctgcggggagggggctcgcgtcgccgtctccagccgctcccgatgaagcagctgcagccgcagccgcctccgaagatgggggatttctacgacccggagcacccgacccctgaaaaaaaagaaagagaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattctaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagtt

SEQ ID NO: 27848 - DNA, 4437 bp, Homo sapiens
ggcactaaaggtttgcttccgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaact

SEQ ID NO: 27849 - DNA, 1478 bp, Homo sapiens
gtttgcttccgggcgtttcttttgcttccccttccctctttcacgcttcctcccctccccctcctcccttatcccttcgctttcgctcttttccgtcgaggccgacccctgagttaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaa

SEQ ID NO: 27850 - DNA, 1045 bp, Homo sapiens
ttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggt

SEQ ID NO: 27851 - DNA, 4363 bp, Homo sapiens
ctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaa

SEQ ID NO: 27852 - DNA, 1404 bp, Homo sapiens
atgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccacgtgagtgtttctcccttattccttagctcagttttctcctctaccttgtatttcttcttaggacatccagttgaaaagccctagtgtttttggtatttcagtctcaaagagcataagtttggttgatgtcttttgctcccaaaggtcagtttgctcccaaaagagatacagttttattgttcatctccaggactgggtctttgtagacaaagagtgagacactagaagatcatgaatggccttgagtagactgctcacgttatagatgtgcttcaatttcatttctaagtgagttacgttggaaaaggtgttacttctttcctagtgtcatactgcacctaacatttgtataaatgtgtagtctgcataatgctttccacagaagctgtgttagatggaacctcatagtgtccactatatttgttaccctggcttgggagcagactcctatggaaacaatcatttttaactgcagaagaatcaactaacacttttgtttacacataacatgacagtaaacacattctgagtctcttaaaaacctgatagagaatgagaaggaaggactaatttttttcatttcatgatgccacctgatctttttaaatttaccactagactgatcaacaagtgagcaagaatttccacttgaattttccagaggagaaacatccatttgtgtaaaataagtgaatcacctatattgtacatttcttatttagtatttacttgatttgtaagtatgtacagtttgtacattaggtttattacttaggtggtcttggctttgcttcccttgaggttctgattttactttttctctccttttcaacttaaaaagtatcaaatgtctcctggccaagtcttttccctatcaagacatgccctacctgccctctcagttctacttcttccttgaaacagtg

SEQ ID NO: 27853 - DNA, 668 bp, Homo sapiens
aaaggtttgcttccgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggaggtgcggggaatactaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgcctt

SEQ ID NO: 27854 - DNA, 3854 bp, Homo sapiens
ttggtgaaaaagagcccttgaagctggaagacgggaggtgcggggaatactgttgagttatttgaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaacgtgagacccctctccccacctctagatgctggattatcccatggtcctcagatttcttttaacatactctataagcccttttcttgttataaactcttgatctcaaagga

SEQ ID NO: 27855 - DNA, 587 bp, Homo sapiens
agttttcgtcgcctctgaggggcgccccgcggctttggatttgaccccgtcaggctaccgtcgcggtgaccggaacggcactaaagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatg

SEQ ID NO: 27856 - DNA, 2043 bp, Homo sapiens
ttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgaaagcttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttc

SEQ ID NO: 27857 - DNA, 3306 bp, Homo sapiens
cctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaagggagcatcacagaaagaagtgaatgcccaaagcagtgatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaa

SEQ ID NO: 27858 - DNA, 6183 bp, Homo sapiens
atccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaaggatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaactcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaatatctggatcgataaaacactgtcccatcaaccatttgagtggggagagggagaagctcttctgtaagtaagattctggcaagctctttgaaatgagtcttctttcccacagattttctctactctttctatacaaacagataggagaagagggaatagaaacctggaggaacttgaatatttttgttctagatagagatacagttactgaaaaggaaacctagaaagtagtcacacgttgcttatttaggccagaagtaattgtactgggcaaaaatttcacttaaaaaacacaagaagtccaggtatggtggctcagacctgtaatcccagcactttgagaggccgaggcaggtggattacttgagcctaggggttcaagaccagcttgggcaacatgtcaaaaccctgtctctacaaaaaatacaaaaattagcctggcatgatggcatgtgcccgtagtctcagctactcaggagtgaggtgggaggatcatttgagctcagaaggtcaaggctgcaatgagacataatttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcccatctcttcactgtttctggaattcctgttttccagatgttagacctccagaatttgatctctaattttcctatcttttctcttaactttcagctctgtcttcttgctaggaccttttcctaggagcatttctcaatttaatcttccagttcatctgttgcattttatttttctagtctcatattgtctcatatttttaatttctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactgg

SEQ ID NO: 27859 - DNA, 2517 bp, Homo sapiens
ccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 27860 - DNA, 1997 bp, Homo sapiens
ggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgataaaaacaagaatacctacttacgatgaagatgacaacactattctttatgcgtatgaaacaaaacctgaatttgtcaataaagaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttg

SEQ ID NO: 27861 - DNA, 2830 bp, Homo sapiens
ggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttca

SEQ ID NO: 27862 - DNA, 2679 bp, Homo sapiens
cggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttca

SEQ ID NO: 27863 - DNA, 2677 bp, Homo sapiens
gtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaatagcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttc

SEQ ID NO: 27864 - DNA, 817 bp, Homo sapiens
gggaatacacgatttggcttaggggccggggctctcctgaggagagagggtttgctttgcggggaagagcgagtcttgacttcgcagcctccaatttcagccgcggtgtggaggggggtgctttgggtggtccccacagcctttccggagtgcccgcgcgtgtaagcttttgagatttgacaatttgtgaagtgcttggtgctgactttcggggacgacaggatccttttacagtcattctcctgtcaggggaggcaggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcct

SEQ ID NO: 27865 - DNA, 4200 bp, Homo sapiens
ggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtcaagtacatcttctgtacaaagggatgatttccactgggaggagtatttgaaagagactgggtctataagtgctccttcagagtgcttccgtcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattc

SEQ ID NO: 27866 - DNA, 1514 bp, Homo sapiens
gctagaaattcaggcttgctcaggcaacatgggctttgttgacttgctttctccagaaaggcaattttattcctggtaaggagcaaggctatcctatcatttggaacctaaatcaccttaacggtaaaaacagcaacaacttgtttctctggaatattgataaagttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcag

SEQ ID NO: 27867 - DNA, 2435 bp, Homo sapiens
cagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattc

SEQ ID NO: 27868 - DNA, 1957 bp, Homo sapiens
ggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggaaattgatgggaaggctctgttcctactcaagagtgatgtgatgatgaagtatatggggctgaagctggggccagcattaaagctgtgttactacattgaaaagcttaaag

SEQ ID NO: 27869 - DNA, 845 bp, Homo sapiens
gtaacaaagaatctggtagaagtgagttttggatagtaaaataagtttcgaactctggcacctttcaattttgtcgcactctccttgtttttgacaatgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagctcaccgcagcaacgggaccgctacagccactggacaaagctgtaggacaatcgggtaacattggctacaaagacctacctagatgctcctttttacgataacttacagccctcactttcttatgtttagtttcaatattgttttcttttctctggctaataaaggccttattcatttca

SEQ ID NO: 27870 - DNA, 591 bp, Homo sapiens
atgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagcgcagcaacgggaccgctacag

SEQ ID NO: 27871 - DNA, 498 bp, Homo sapiens
atgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaaggacaacaggttgtacagggatga

SEQ ID NO: 27872 - DNA, 4002 bp, Homo sapiens
aagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactgtgctact

SEQ ID NO: 27873 - DNA, 3739 bp, Homo sapiens
ggcgggcgtggaccgcgcgggagttaagaagcaggtcccggatcgccgtataccgccgggttttctcccaacgtcaggcccgatggctcggcttccccagaaggggaagataaaagactttgattcatgaagaatctgctcactgagaagtgtatatcaagccacaatttccatcaaaaagtgattaagcagagaatggagaagaaggttgattccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttca

SEQ ID NO: 27874 - DNA, 3788 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccagattttactatgagcagcgattactacggaaggtcttcgaagaatggaaagaggagtggtgggttttccagcacgagtggaaactctgtgttcgagctgactgtcactacagggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 27875 - DNA, 3498 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 27876 - DNA, 4162 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaa

SEQ ID NO: 27877 - DNA, 4005 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 27878 - DNA, 449 bp, Homo sapiens
gagttaagaagcaggtcccggatcgccgtataccgccgggttttctcccaacgtcaggcccgatggctcggcttccccagataccgtgttttttacaaattgaaagtttgtagcaagcagccctgcaccgagcaactattttttcaacagcatgtgcccacttcctgtcacttacactttgttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgac

SEQ ID NO: 27879 - DNA, 4086 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 27880 - DNA, 593 bp, Homo sapiens
ttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 27881 - DNA, 2450 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattta

SEQ ID NO: 27882 - DNA, 267 bp, Homo sapiens
gagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctacaccattggggttacattaaatttattaataaacta

SEQ ID NO: 27883 - DNA, 2041 bp, Homo sapiens
gtagctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcccatctccaggtcttagtttctttgtctctgtggttgggtgggatgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttactgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactgtggctggagccccaaagtgtggagcattgtgagatttggggtcacagcaatttatggctactattccctgggtctggtaggtaggacaaatgtcctcttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttcccatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgc

SEQ ID NO: 27884 - DNA, 2523 bp, Homo sapiens
gtagctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcccatctccaggtcttagtttctttgtctctgtggttgggtgggatgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttactgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactgtggctggagccccaaagtgtggagcattgtgagatttggggtcacagcaatttatggctactattccctgggtctggtaggtaggacaaatgtcctcttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttcccatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgcaatacctatgctcatttattttttatgtttacccattggttagggcctcctgtatacattaaacagttcatagtcatgatagtgagtattcttacactgttcccagtattacagggaatgcttagaaattttctttatttaaacattatgtttgttgtagccttgttaaaggctattttataatttttactagaaatattttgacatttattgtgatttttttctatctctaatctattgagatagtcacattccttttgtcttcactccattataaaggtaagttaccttaataaaattgttgatatcatttcatc

SEQ ID NO: 27885 - DNA, 3095 bp, Homo sapiens
gggctccgggaggcagctgcggctccgactgctcaggaacctcctcctgggcccggcagagagagaccccgagtcccccggagtccgactcgctacgcgggtcttgcgagatatctggccgcctctgccgcagctggagcagagatggggtttcaccgtgttagccaggatggtcttgatctcctgacctcatgatccgcctgtctcggcctcccaaagtgctgggattacaggcgtgagccactgtgcccggccttgaacattcttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcaggaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttc

SEQ ID NO: 27886 - DNA, 4865 bp, Homo sapiens
cgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtg

SEQ ID NO: 27887 - DNA, 3088 bp, Homo sapiens
aagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtg

SEQ ID NO: 27888 - DNA, 3134 bp, Homo sapiens
aagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtg

SEQ ID NO: 27889 - DNA, 1532 bp, Homo sapiens
cttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagcc

SEQ ID NO: 27890 - DNA, 1488 bp, Homo sapiens
aaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggt

SEQ ID NO: 27891 - DNA, 5406 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 27892 - DNA, 2062 bp, Homo sapiens
atagtaatgagagtccgtgccgggtggagctcagaaggacatgggattcccggtgctgtgccgtggctggaggaggacctggcctggctgtgccagttggctgggagcccctccaccccagaagcccttgctctcacctcttcttctgaatcatcgttcttcgaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggttt

SEQ ID NO: 27893 - DNA, 3227 bp, Homo sapiens
agaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaa

SEQ ID NO: 27894 - DNA, 1630 bp, Homo sapiens
gcgaggatgggagtccccaggacccggagctgagcagcctggcgcgcggcgggcagggcgcgcaggacagaagcctcgctgttcctccgggagcccaacaccgttcccgcgcggccacgatgatccctccgaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgct

SEQ ID NO: 27895 - DNA, 4422 bp, Homo sapiens
gtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataa

SEQ ID NO: 27896 - DNA, 8987 bp, Homo sapiens
atgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccagtctaggtgctggggacacatcagtgagccacaccacactctgctctctggaagtgcacgaagtcaacaaagccgaagtgcttcctctgcactccatgtctgtgctatgtattcatctttttcctgtgtcagaatctcgttgctttttcatggccgaataactgaattaaaacagtacaaaaagagcacccccttccaggtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaaggggttattaggaaggtatcagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 27897 - DNA, 897 bp, Homo sapiens
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaaggggttattaggaagggaaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttag

SEQ ID NO: 27898 - DNA, 7198 bp, Homo sapiens
atgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaa

SEQ ID NO: 27899 - DNA, 2047 bp, Homo sapiens
atgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataatgtactgtgtgttgcagaaaactgccttcctttcttcttaatgtcacaattattcctattgaccctgttgcaggcaaaggtacacttgaccttgagacaaggtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggttagtgaaccttacggtttggaatctgtaatctgaatgtaacccagtttactttataaggtgtattcttaaattagtactccttgggaacagaattgccagacagccaactcagagtgactggtcaatggagaacactttgaacgagccatctttgcaatgccaaaatgtcctcccacaaggagtatgttaaatttggaatacccttatcgaatggaagttttcattggaataaattattgtagtttgtcctaggactttttttcatttcaagtaatttattttgctacctctttgaaaacctgcatgctccca

SEQ ID NO: 27900 - DNA, 7884 bp, Homo sapiens
atataatgagcggaccgctgccaaagtcagagggaaaatgaagtctttgttaaatgccttcaccaagaaggaagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 27901 - DNA, 939 bp, Homo sapiens
ctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcc

SEQ ID NO: 27902 - DNA, 8829 bp, Homo sapiens
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 27903 - DNA, 912 bp, Homo sapiens
atgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccag

SEQ ID NO: 27904 - DNA, 7145 bp, Homo sapiens
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagcgatccgggccctggacctggaggggtggggggggcgcccctccctccccctggcgcgcccaggagctgtattcgaattcgagctcggttccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatgaag

SEQ ID NO: 27905 - DNA, 7130 bp, Homo sapiens
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagcgagcctggcgcgcccaggagctgtattcgaattcgagctcggttccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttggtgagtggcgggggagggaggggagcgagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgtcgatcccccatggtcgggctcaggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatgaag

SEQ ID NO: 27906 - DNA, 7777 bp, Homo sapiens
agtgcgcgccgagcgaagggcggcggcggtggcggcggcggctcgtgctcggccccggctgcgattgcgctcagctccaggttccctgcccgcggcggcgcgcccccagcgctccctgcaccccgcgccacccgcacccgcgctcggcccgctgcgggcggaggagcggccatgccgccgcggcgcagcatcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctggaaggctggtggaagatcaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaa

SEQ ID NO: 27907 - DNA, 3276 bp, Homo sapiens
gtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggtattataaaaaaaccaggccgggtgcggtggctcacgcctgtaatcccagcactttgggaggccaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtaagtatgtcccatgctgctgggaagctatagagaaaagtgttggatcaagttttatccatttcctatctcaagtcatctcattcatgtccctgctttgtgttcaggtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtgagtca

SEQ ID NO: 27908 - DNA, 2681 bp, Homo sapiens
attatccatgtaacagccatagcacaatcctgggtacatggtaagtccttggtaagtgttgcctgtgccacactattattatattacaggtgctgttgttccccaagtgtaaagtaaatgatattttattctcttcataagctatgttcccattgcaaaaggactgtgccctgaattttaaattagttaatttttagttaaaagtgcattttcccatgaagctaaaatgtaaatgaaggtcaggttcccattaccctaactcagaacatagctgaatatcttgtgtttatgtcaaaagctagtgggaaacaataatagtcatcagaacagataaatggcagaataaaaaagatttaaaaacccctcatcttgaatgttggtgtttgaagaaaagcaggtttgatagagaagccttgattagatgtaagggtaaatgtaatattctgtgatgattccaggagggtcttctgggcattttcaagggcatcgggtgtggatgataccggactttattttgtctaattgcattcttgagagagccttccctcttttccctacctttttccttattgcataggatctcatctgagtgactgtgtgctaatctcaggaaaggccttggaggccccaggcagttcctctgagcactctttatccctcactggatgggagctgaagggaggttgtatgcatcctttatataagtacttcccctgtggctgatttttccatatcagagaattttctctctcttagattttcttttttaattttggcttttggctctttgaagcttaaaagtgatgtttttagatggtatcccacagccaccttgcaaatattccaaagacatgattgtaagcctttgttccctgtaaaagattgctctgtattaaaacaaatccaccaaacaacaagtcatagacccgttagaaaccagcattctaaagcatggtttaagtgtgaacaggtgtttgtagcttatctgagactgacagtaggtaaaggggccaaggagagactgctacatggtggtacccaagataattctctgaagagagagacttttgtgtgaggaagacatttattatacagagtgatttattgcaattcttagctactccatcaagctagacttgtcaccatgtcccattaaaagggtttaagaagaattctttctcagaatcctgcattacagtagcatctgcaataaggagaaaattttcttctgggaatcactccaggaaaccttgacccatcctctacttagtcactcttatagagccctgcattttcttttgtagcatttatgacatgtgtaatgttacatttgtttgtgggattatttaaggaatgtctgtcatgtgagacaataagctttatgagtacaggcacctcttctgtcttatttcctatgccccagcacagtccctgacatctagtagaccttcaaaaagttttatggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacattt

SEQ ID NO: 27909 - DNA, 4059 bp, Homo sapiens
agggaggaggcgggaggagggacaccgttgggaggctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagt

SEQ ID NO: 27910 - DNA, 4153 bp, Homo sapiens
tgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacac

SEQ ID NO: 27911 - DNA, 1251 bp, Homo sapiens
gctgcttttatcgaccaatcaaatattttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctgacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 27912 - DNA, 780 bp, Homo sapiens
tgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggtt

SEQ ID NO: 27913 - DNA, 816 bp, Homo sapiens
ggcggggaggggcgtcttgggcctggagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactc

SEQ ID NO: 27914 - DNA, 1014 bp, Homo sapiens
caggagccgcggcggggaggggcgtcttgggcctggaggtcagtgtggcctcgcgtttgtcttcggtgacgggaaattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 27915 - DNA, 585 bp, Homo sapiens
tgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttaggtaacttgagtcagtagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcg

SEQ ID NO: 27916 - DNA, 5273 bp, Homo sapiens
tcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagttttgttttggtctcgtcagcactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 27917 - DNA, 4888 bp, Homo sapiens
ccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaa

SEQ ID NO: 27918 - DNA, 5284 bp, Homo sapiens
gaaatccaacttctgaaatgttctgggtggtagatagttaagggtgaagctgtattggtcttagtatttgcagatgttgtagctgactgctcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccc

SEQ ID NO: 27919 - DNA, 5096 bp, Homo sapiens
tcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagttttgttttggtctcgtcagcactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 27920 - DNA, 4195 bp, Homo sapiens
cccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 27921 - DNA, 5204 bp, Homo sapiens
tcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagttttgttttggtctcgtcagcactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 27922 - DNA, 5107 bp, Homo sapiens
agccatttgcttcctgagtggccacattccagctgtgcagactggtcatagcacatctgccaatcagaacaggccctggagggaagcccttggatactgagtcttgtttacatgcatcgtgactctgtttctcccttcctcttgtgtgttgtaccactaggaagattagtggggaaatttgctattacatgcctaagtaaactatgtaactaggatcacagccacaggaaatgatgttctggacagagttttagctcggctttagccacagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 27923 - DNA, 3027 bp, Homo sapiens
aaagcggttggcagcagcggcgcttggaggaaaggaagccggttggagggcgcagcgcacccctgctgcgcggaggagggggctgagctgaactcagcagaagttacatgcacaaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcccgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcctggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttggcaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccagcttcctgagtatgctccacttaa

SEQ ID NO: 27924 - DNA, 5607 bp, Homo sapiens
cctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcccgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcctggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttggcaaggccacaaccctggtgtccactgcctcaggcacgcagaccgtgtttcccagcaaatgaacctacgggtggcttttcctagaccccaaagagagcctgccttggtcatcttcccaggaggaattcatgacaactgggatgcagaagagagcaaatgatctgctgggatggaaactgctcaatggagagtttgtggactgcatgatattccttgaacatcagggatggtacagggataccaatagtctggcctccaagacaggagagtaataggaggaagagcaaatctgtcttcacctgcagtattaatgggtggtgggccagaatggaggaaagcaagtgagtcatgtgctgctacaggttacaccaaactcccatccctctgttactcactgctgttgtcaaagccaaactttatcttgctaatttctcacagcttggcacctaacaaatgacaaggcaggacatccaatgccttcgagctctgtggtctggcctgtctctccagatcagatttagagtgaggtagcagatgacataatattctctttggtgttcaatccgaagaggccaatgcttcagcacaatgtcccctagccatcacccccagcccgactccccaccaagcatcctgcatccctctgccacatcttcattcttttccattctgtcttttccccgataccttctgaccccagggatttctaatagagcataatgatcaagaaaataaagacctggtacataaagagtctcagaaaaaaaatccatgatgttatatgaaagataccaaactgcaatgcttacaaagaggctatttcaagtagaaagatataaatatcacttataaccatgcatcctttatgttcataaataagtcatcataaagaacaagccattagaagacattctaatccttgtttttaaaaaaaagactataatctaagatacaattctaaaattactgtgctaacctgcaagagacattgctcacataaatgaaattcatatataccgtgatgttatttgaaccatatattttcatcttctcctcctctcttaagacatcaataagaatttgatttttaaaggcacatgctgctctgattatcaaagacaataacacaaatgcagcatcactgggatatgtcggttgttttaaagttcagatcctaattttactgaggaagcatcctcagtttttcatccagccctgcttgtaaacaggatccagcatcagccagaccatgagcagagtaaggattgcatctggaggttacagaaatgttttcttctatgtgaagctatcacatgcaggggttaaacaggcagccatcttttaatgcgatgaataatttggacttcttagccacacccttgtctcggttaaccacaggaggaggtgacaatacaccacaagaagccccagagttctggctttatctgccaagtggtaggtgagaagggaagaggtgggattgagcacactggctatttataccttgtcttcaaagccctcttagtcacatttccatcttcatgcattggcttctgccttacaattgagcaataggaaaccaccactcctaatttttgcacgtgctgctttttaagtctctgggaactttccatgaggtatagtggagggtttcataaggatttagctcttccttcgaacctgcttggccgataaaccagatatttttttaaaacacagcatacagattccaaatgatcaaggatcaaaaagtgttggggatgtcaggaaggatgcaaggatgggcttgaatgatcacaatgagtcaacccagaaatgtgcagtagaatagtttgctaatggtgacatctgagttgcatctcccggaaatattgtttcttattattacactttgggtcgggggaaggggtgttaagggtaaaaagaggaaggagcaaatagataaagagaaaaattcatgcctccaggaaacataagcagaaaaactatagacttgtgtctctgcttatttttttaagtacagtgtttttaatagaccaaagagaatctctatgagttaatatgtatgtgaataatgtttataaaaggggtataatgtgttagtcattatggaatattgtataaataaaccttccatatataaaacatataaaaaatgattgcttagggcagtggacacttaaggacttccaaacctttcatatcttcatcccaaaaaatagagcgttccagggctggcaacttatttccttagtatattccactgtaaagccaagaggtgtgggggcttgttttctggttttgtaatttgtaataatccgtatggattactgtaaaatgtctgttgcatgtgtgttggtgttggtgttggtgttgtttacccacatggagtcatcagagatttgttccacactttgtatcctggaaaaccaaaaggaattttcttttcttcgagacagagtctcgctctgtcgcccaggctggagtgcagtggtgccatcttggctcactgcaacctccgcctcccgaattcaagtgattctcctgcctcagcctcccgagtagctgggactacaggtgcgtgccaccttgccctgctaattttttgtatttttagtagagacggggtctcaccgtgttagccaggattgtctcgatctcctgaccttgtgatctgcccgcctcggcctcccaaagtgctgggattacagacgtgagccaccatgcccggcctggaattttctagtaagaagaaaaacatacagaatatgtcttcactgttgggtaactctcaaatttgtagcaatccagattttttgtaaaactgtgctaatgggatatttaatgtcagagttattgtctctcacttcaatatctagtactggataatgtttctcctgggagcacgtatttttttttcaagtcctcttttcctggacttaacatgttcttctagaagacaccagaagtcatgaccctaagccccctcccttcaggaccactttctaccatcggttttcaaaaaactatccacatgttaattctgttttatgttctgtgattctgtggtagactcagtgctttcagagtccagagcttgacttgggttagtggccttaatgaagtgctaaatttgctctttaccgcgagactgatcagaagaagcaaaaggggaaagggggctagaggtccactcgcaccttttacatcagacaagaggaggactgtgccagaaatctgtgcatgaaacaccatctgctcttcatgcagggaggggtcaaccgtgtgaacgtgcagagattactcgagccttctttgccaaaaatatgcattcttcccagctgtaagcgtgtgaagccaaatatgtcttttagcatgaaacaataaaaacatgtttattttcacttaataggttattccccaggcc

SEQ ID NO: 27925 - DNA, 1372 bp, Homo sapiens
acttttggggaccttcatttaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggcagtgaggcctggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttggcaaggccacaaccctggtgtccactgcctcaggcacgcagaccgtgtttcccagcaaatgaacctacgggtggcttttcctagaccccaaagagagcctgccttggtcatcttcccaggaggaattcatgacaactgggatgcagaagagagcaaatgatctgctgggatggaaactgctcaatggagagtttgtggactgcatgatattccttgaacatcagggatggtacagggataccaatagtctggcctccaagacaggagagtaataggaggaagagcaaatctgtcttcacctgcagtattaatgggtggtgggccagaatggaggaaagcaagtgagtcatgtgctgctacaggttacaccaaactcccatccctctgttactcactgctgttgtcaaagccaaactttatcttgctaatttctcacagcttggcacctaacaaatgacaaggcaggacatccaatgccttcgagctctgtggtctggcctgtctctccagatcagatttagagtgaggtagcagatga

SEQ ID NO: 27926 - DNA, 9211 bp, Homo sapiens
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 27927 - DNA, 414 bp, Homo sapiens
gggcgcgggcgggacggagctgcggcggcggcgggtcccgcgggcgggagcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctag

SEQ ID NO: 27928 - DNA, 2318 bp, Homo sapiens
gtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttg

SEQ ID NO: 27929 - DNA, 9211 bp, Homo sapiens
acttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 27930 - DNA, 2265 bp, Homo sapiens
gggcgcgggcgggacggagctgcggcggcggcgggtcccgcgggcgggagcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttg

SEQ ID NO: 27931 - DNA, 727 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagctcctgcccatgttaactcagccgacaccgcagcagcatggtgacaggtccccccagggtgtctgcctctacagaggaagggactgaagcacccagagagctggcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 27932 - DNA, 551 bp, Homo sapiens
agcgcctggcggccgagtcaagccgccgcctcgacccagggcccgcgggccaggagagcgctcggcgggctgacccttggccctctgcctgccctgctggctggctcccactcatcctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 27933 - DNA, 9158 bp, Homo sapiens
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 27934 - DNA, 557 bp, Homo sapiens
actcgaggccagaaagggaagcccctttccagtgggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaag

SEQ ID NO: 27935 - DNA, 876 bp, Homo sapiens
acggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactcc

SEQ ID NO: 27936 - DNA, 2351 bp, Homo sapiens
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 27937 - DNA, 688 bp, Homo sapiens
cttgaaattcatagaaccgggtgcaagacataacagccctctgtgtggcctcagatggcagagcagggtggcagcagctgccctggcaggaagagcatgctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggctt

SEQ ID NO: 27938 - DNA, 609 bp, Homo sapiens
aaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaaga

SEQ ID NO: 27939 - DNA, 5044 bp, Homo sapiens
gaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 27940 - DNA, 5194 bp, Homo sapiens
cgcccaggcgcgggaccaccctccgcccgccgaggcgggggcccagcgcgcccggcactctcggcggtccgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaa

SEQ ID NO: 27941 - DNA, 5231 bp, Homo sapiens
accttaagagggacaactgaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccaggtcaggctggaggcttttgcatttggtttggcgaggagagacagcaggatttctgggtgccggacatgcttctcggtcagagctgcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 27942 - DNA, 593 bp, Homo sapiens
gtgagtcccgcggagccgcgcgcgcccccggctgggccgagccgctggccgacgagcggagcctcaggagccggcggggacgccatgcgagccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagc

SEQ ID NO: 27943 - DNA, 2055 bp, Homo sapiens
gggaccaccctccgcccgccgaggcgggggcccagcgcgcccggcactctcggcggtccgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctcccatcaccaagcgctggaagcacctcactgggactctgatcttggtgaactccctggacgttctgagagcagccgccttcagccctgcggaccaggacgacttcgtgatttga

SEQ ID NO: 27944 - DNA, 570 bp, Homo sapiens
aacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaat

SEQ ID NO: 27945 - DNA, 829 bp, Homo sapiens
cgcagttggctggtgtttgtttgcacaaggattctttggtaacaatctgcagtcggtttctggcggaatgtgaggtgaagtcacgactgactttcgggatggagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatggg

SEQ ID NO: 27946 - DNA, 500 bp, Homo sapiens
agcacagcagcaggggaagaggacagtgaggctgggatgcagcctccatgcagcctgtcgctttctccacaggagctctggcctgggccagactgccgagtcaccctgattcaggagtaggcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaa

SEQ ID NO: 27947 - DNA, 1766 bp, Homo sapiens
acatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagaccttttt

SEQ ID NO: 27948 - DNA, 2017 bp, Homo sapiens
ccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggctt

SEQ ID NO: 27949 - DNA, 903 bp, Homo sapiens
aggcttttttttttttttttttttttgagacagagtctcactttgttgcccaggctggagtgcagtggcacgatcttggcttgctgcaacctccacctcctggattcaagtgattctcctgcctcagcctcccgagtagctgggagtacaggctcccacaaccatgcccagctaatttttgtatttaggtagaggcggggtttcaccatgttggccaagctggtcttgaactcctggcctcaagtgatccacccgccttggccttccatagtgctgggattacaggtgtgttactgcgcccagcccataagctgccttttaaaattttctccatggagctcttcccatgaaagctgttagtgtctgtaagtcatgaaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctg

SEQ ID NO: 27950 - DNA, 2822 bp, Homo sapiens
gcgctgactgccgcggcagaaagggggcggccgcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 27951 - DNA, 1880 bp, Homo sapiens
gagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaa

SEQ ID NO: 27952 - DNA, 826 bp, Homo sapiens
tagctgggagtacaggctcccacaaccatgcccagctaatttttgtatttaggtagaggcggggtttcaccatgttggccaagctggtcttgaactcctggcctcaagtgatccacccgccttggccttccatagtgctgggattacaggtgtgttactgcgcccagcccataagctgccttttaaaattttctccatggagctcttcccatgaaagctgttagtgtctgtaagtcatgaagagatctggttctcttatttggaactcatcagatacatggcagagggtgtgaagaggtgctgggcccgtggtacagcagccacctttcagaaggccgtcaaaagagcatcttttcttgcttgaagaaataagggattcataactgaagcagagagaactgggagaagagagtttacccttaaatgttgctgaattgaaatactaaaaaattcctaaaaaggcaaatacaaatcccattttaggatcctgtgggattcatcctgtctcctggagttggtgtgaagcatataggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtcc

SEQ ID NO: 27953 - DNA, 2190 bp, Homo sapiens
aattcataaattcttggccagagtgtgcccatcaacaggggttacacttgccacctccttaaatcccagctcaatgcattctccatgctcctggctattcagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcagagatctggttctcttatttggaactcatcagatacatggcagagggtgtgaagaggtgctgggcccgtggtacagcagccacctttcagaaggccgtcaaaagagcatcttttcttgcttgaagaaataagggattcataactgaagcagagagaactgggagaagagagtttacccttaaatgttgctgaattgaaatactaaaaaattcctaaaaaggcaaatacaaatcccattttaggatcctgtgggattcatcctgtctcctggagttggtgtgaagcatatagaatttcgctcttgtcatccaggctggagtgcaatggcgtgatctcggctcactgcaacctccacctcccaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggctt

SEQ ID NO: 27954 - DNA, 3997 bp, Homo sapiens
agtttgattccagagccccactcggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctcttgcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtgatgggaaaactgaggctcagagatatcaagtaatttgcccaagtttacaagctggaggcaatgaactggattcatactcaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatc

SEQ ID NO: 27955 - DNA, 2180 bp, Homo sapiens
cctttctctcagcatcttcttggtagcctgcctgtaggtgaagaagcaccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattaactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcactt

SEQ ID NO: 27956 - DNA, 7273 bp, Homo sapiens
caccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatgatctttaaaaggttctgctttagcaagataaaaagtataaatgatgctactttattttggcaacatggaaattttgtttttcttttccaataaaatccatattttcgtgaaatttttaaaaataaatttgtatcaaggattagtctgaattttatcataatagaaatttataattactaagaattaaatttttaatcatttttaaagctgtgttcttctctacacccacagccaaaatggaaattcactgtatggtatttgggaatatatttcacctgtaaaagaaagaatgtccacaattcaaacggttttgagttaatagataggaatccctcagtcaaactacagaattttttttgttttatatattcttagtcagcagagtgtttgagctataattacaagtatttccacttctaaatcttcttttagaaaagcagataactataataccttggctctgccactgactcctgccgtatgatattggacaaatcactgcccttttcagtttctcatctttagaatggggagttgggattgccagtggttttcaagcttttcttaacagcagggctttttttctaataaaattgcacatggaatcctggtaggcaaaacagctcaaagcaatgcaggagtttctccaacagtttaaattggggctccccagagcatggtttaaataccataacagtacacaatgatctatcatgtgtcttccaactctgaagttccacagttgtaatttactcagataaaccaccttttgaggctttataagcaaacttgtaaaaacacagtaattgaatgatatacaataaaaactgacagagtgtttaccatgtaccagtcactagagatattagctcatttaattctcttatcaatcaaaaaattgtaagtactctttttaattcctgttttacaagtgatgacactgaggcttaaatagaataatctccccaaaatgacacggcagctgaaagtaacccagctattctgactgcaaaggaaacgccttaattgctttgtccaccctgaacaaaacaatctgttttatgtcactatacgtactccatttgaatgccaaggtagaaggcaccatgaaaaaccattaccaaaataaggataattccaataacaaaactgtcaaaaaagaatcactgcttctcaaaatatgattggtatcatcacttattaatgttttgtatcatcacttattaatgattttggcttggtcaccactatgcctggaagatagtaggcactgataaacattgttaaacaccgtaacaacacaaaatgatctaccacatatcaatgtcttccatctctgaaattccatgattctactttactcagatataccaccttttgtggcattataaggaaacatgtataatcaagttcatacaagctatacacagtaggcatcgataaatttgtattgacagcataaacttctagggatgagatttgggaatatacattttgataagtgctccaaatttgagaatcattgctctagtagatctctaaggtccttcttagttctgacattatatcagattttaagcattaaattctaagatgaaaaccatttttctagtcagtttatttttcattcagtccacttaatttcctccaatcttaaaaaatttttttccctaggaaaatccctatctttttcttaaagttactctgttatactatctcagtctcaaagtagcctgaaatgcattttctcattttcatatttctgtccttttcttcaatgtcttaaaagacttgaagtagaagggaagttgcaagctgttatttattcaaatacaaaatcctaatcaatgtttccttctttgcaagggacattcagatctctaacttgtgagttgaacctatttattttgtaagcttttgactttacaaacatgtggtagcctcattctaaaagagttgcacgaatattttttctcaaaataaccacaggctgtaaattaaattgaacaatacagtagaatatgcagatacatactaaacagatgagtgtgtgtgtatgtgtctgtgtttaagcttttccttttccaaaagattatacatttgagcaaaatcccattcagtctaaatgtactcattttgccacatggttttctgatcagcaatttttttaaaaaatggaagtgttacattatatttaataatatcaaaacaagagtgatctctaaatatagctttgaaagttaatataatatgatgtgtccatgcaatgagtcaaattagattgttgatataaatgaacaaatcaatccaagttacattgattaaagggactatttggatgaccagcctcaccatcttttactgtgtgcactttcctcttaaggttttattgtattttccctgctcctttaggcttttttttcatgtggaaaacagtatctaaatgccattctctcacttatgaattaaatatggctaccattaatgttcctttttgtcagtggagtgtatggaaggaaaatgagataggagtacattgcttaagtctctaaatattaaaaacaacaacaaaac

SEQ ID NO: 27957 - DNA, 4554 bp, Homo sapiens
cttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatta

SEQ ID NO: 27958 - DNA, 7957 bp, Homo sapiens
caccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctcttgcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgagaaagaaagaaagaagagagaaaggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtgatgggaaaactgaggctcagagatatcaagtaatttgcccaagtttacaagctggaggcaatgaactggattcatactcaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatgatctttaaaaggttctgctttagcaagataaaaagtataaatgatgctactttattttggcaacatggaaattttgtttttcttttccaataaaatccatattttcgtgaaatttttaaaaataaatttgtatcaaggattagtctgaattttatcataatagaaatttataattactaagaattaaatttttaatcatttttaaagctgtgttcttctctacacccacagccaaaatggaaattcactgtatggtatttgggaatatatttcacctgtaaaagaaagaatgtccacaattcaaacggttttgagttaatagataggaatccctcagtcaaactacagaattttttttgttttatatattcttagtcagcagagtgtttgagctataattacaagtatttccacttctaaatcttcttttagaaaagcagataactataataccttggctctgccactgactcctgccgtatgatattggacaaatcactgcccttttcagtttctcatctttagaatggggagttgggattgccagtggttttcaagcttttcttaacagcagggctttttttctaataaaattgcacatggaatcctggtaggcaaaacagctcaaagcaatgcaggagtttctccaacagtttaaattggggctccccagagcatggtttaaataccataacagtacacaatgatctatcatgtgtcttccaactctgaagttccacagttgtaatttactcagataaaccaccttttgaggctttataagcaaacttgtaaaaacacagtaattgaatgatatacaataaaaactgacagagtgtttaccatgtaccagtcactagagatattagctcatttaattctcttatcaatcaaaaaattgtaagtactctttttaattcctgttttacaagtgatgacactgaggcttaaatagaataatctccccaaaatgacacggcagctgaaagtaacccagctattctgactgcaaaggaaacgccttaattgctttgtccaccctgaacaaaacaatctgttttatgtcactatacgtactccatttgaatgccaaggtagaaggcaccatgaaaaaccattaccaaaataaggataattccaataacaaaactgtcaaaaaagaatcactgcttctcaaaatatgattggtatcatcacttattaatgttttgtatcatcacttattaatgattttggcttggtcaccactatgcctggaagatagtaggcactgataaacattgttaaacaccgtaacaacacaaaatgatctaccacatatcaatgtcttccatctctgaaattccatgattctactttactcagatataccaccttttgtggcattataaggaaacatgtataatcaagttcatacaagctatacacagtaggcatcgataaatttgtattgacagcataaacttctagggatgagatttgggaatatacattttgataagtgctccaaatttgagaatcattgctctagtagatctctaaggtccttcttagttctgacattatatcagattttaagcattaaattctaagatgaaaaccatttttctagtcagtttatttttcattcagtccacttaatttcctccaatcttaaaaaatttttttccctaggaaaatccctatctttttcttaaagttactctgttatactatctcagtctcaaagtagcctgaaatgcattttctcattttcatatttctgtccttttcttcaatgtcttaaaagacttgaagtagaagggaagttgcaagctgttatttattcaaatacaaaatcctaatcaatgtttccttctttgcaagggacattcagatctctaacttgtgagttgaacctatttattttgtaagcttttgactttacaaacatgtggtagcctcattctaaaagagttgcacgaatattttttctcaaaataaccacaggctgtaaattaaattgaacaatacagtagaatatgcagatacatactaaacagatgagtgtgtgtgtatgtgtctgtgtttaagcttttccttttccaaaagattatacatttgagcaaaatcccattcagtctaaatgtactcattttgccacatggttttctgatcagcaatttttttaaaaaatggaagtgttacattatatttaataatatcaaaacaagagtgatctctaaatatagctttgaaagttaatataatatgatgtgtccatgcaatgagtcaaattagattgttgatataaatgaacaaatcaatccaagttacattgattaaagggactatttggatgaccagcctcaccatcttttactgtgtgcactttcctcttaaggttttattgtattttccctgctcctttaggcttttttttcatgtggaaaacagtatctaaatgccattctctcacttatgaattaaatatggctaccattaatgttcctttttgtcagtggagtgtatggaaggaaaatgagataggagtacattgcttaagtctctaaatattaaaaacaacaacaaaac

SEQ ID NO: 27959 - DNA, 4080 bp, Homo sapiens
ggagaaagagagacggagagagagagagacgcacagatgtgcacggaggccacagacactgacatttggaattccttcaggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatta
